United States Patent
Guffy et al.

(10) Patent No.: US 11,718,838 B2
(45) Date of Patent: Aug. 8, 2023

(54) OPTIMIZED PROTEIN LINKERS AND METHODS OF USE

(71) Applicant: Pairwise Plants Services, Inc., Durham, NC (US)

(72) Inventors: Sharon Leigh Guffy, Chapel Hill, NC (US); Joseph Matthew Watts, Cary, NC (US)

(73) Assignee: Pairwise Plants Services. Inc., Durham, NC (US)

( * ) Notice: Subject to any disclaimer, the term of this patent is extended or adjusted under 35 U.S.C. 154(b) by 187 days.

(21) Appl. No.: 17/381,465

(22) Filed: Jul. 21, 2021

(65) Prior Publication Data

US 2022/0025346 A1    Jan. 27, 2022

Related U.S. Application Data

(60) Provisional application No. 63/054,449, filed on Jul. 21, 2020.

(51) Int. Cl.
| | |
|---|---|
| *C12N 9/22* | (2006.01) |
| *C07K 14/00* | (2006.01) |
| *C12N 9/78* | (2006.01) |
| *C12N 15/11* | (2006.01) |
| *C12N 15/90* | (2006.01) |

(52) U.S. Cl.
CPC .............. *C12N 9/22* (2013.01); *C07K 14/001* (2013.01); *C12N 9/78* (2013.01); *C12N 15/11* (2013.01); *C12N 15/907* (2013.01); *C12Y 305/04002* (2013.01); *C07K 2319/00* (2013.01); *C12N 2310/20* (2017.05)

(58) Field of Classification Search
CPC ................................................ C12N 2310/20
See application file for complete search history.

(56) References Cited

U.S. PATENT DOCUMENTS

| | | | |
|---|---|---|---|
| 11,072,785 B2 | 7/2021 | Guffy et al. | |
| 2007/0027309 A1 | 2/2007 | Weinstock et al. | |
| 2007/0044171 A1 | 2/2007 | Kovalic et al. | |
| 2011/0182862 A1 | 7/2011 | Green et al. | |
| 2018/0237787 A1* | 8/2018 | Maianti | C12N 15/907 |
| 2018/0245095 A1 | 8/2018 | Abad et al. | |
| 2018/0312828 A1* | 11/2018 | Liu | C12N 15/62 |
| 2020/0392473 A1* | 12/2020 | Zhang | C12N 15/8203 |

FOREIGN PATENT DOCUMENTS

| | | |
|---|---|---|
| WO | 2005049642 A2 | 6/2005 |
| WO | 2014020129 A2 | 2/2014 |
| WO | 2018027078 A1 | 2/2018 |
| WO | 2019051097 A1 | 3/2019 |
| WO | 2019120310 A1 | 6/2019 |

OTHER PUBLICATIONS

Chen et al. (2013) Fusion protein linkers: Property, design and functionality. Advanced Drug Delivery Reviews, 65:1357-1369 (Year: 2013).*
Anders, C., Niewoehner, O., Duerst, A. & Jinek, M. Structural basis of PAM-dependent target DNA recognition by the Cas9 endonuclease. Nature 513, 569 (2014).
Chen et al. "Fusion protein linkers: Property, design and functionality" Advanced Drug Delivery Reviews, 65:1357-1369 (2013).
Conticello, S. G. The AID/APOBEC family of nucleic acid mutators. Genome Biol 9, 229 (2008).
Gaudelli, N. M. et al. Programmable base editing of A•T to G•C in genomic DNA without DNA cleavage. Nature 551, 464 (2017).
Hua, K., Tao, X., Yuan, F., Wang, D. & Zhu, J.-K. Precise A•T to G•C base editing in the rice genome. Mol Plant 11, 627-630 (2018).
International Search Report and Written Opinion corresponding to International Application No. PCTUS2021042457, dated Oct. 8, 2021, 11 pages.
Kim, J. et al. Structural and Kinetic Characterization of *Escherichia coli* TadA, the Wobble-Specific tRNA Deaminase†. Biochemistry-us 45, 6407-6416 (2006).
Koblan, L. W. et al. Improving cytidine and adenine base editors by expression optimization and ancestral reconstruction. Nat Biotechnol 36, 843 (2018).
Komor, A. C. et al. Improved base excision repair inhibition and bacteriophage Mu Gam protein yields C:G-to-T:A base editors with higher efficiency and product purity. Sci Adv 3, eaao4774 (2017).
Mali, P. et al. RNA-Guided Human Genome Engineering via Cas9. Science 339, 823-826 (2013).
Malzahn, A. A. et al. Application of CRISPR-Cas12a temperature sensitivity for improved genome editing in rice, maize, and *Arabidopsis*. Bmc Biol 17, 9 (2019).
Notification of Transmittal of International Search Report and Written Opinion corresponding to International Application No. PCT/US2020/042553, dated Oct. 28, 2020, 14 Pages.
Rees, H. A. & Liu, D. R. Base editing: precision chemistry on the genome and transcriptome of living cells. Nat Rev Genet 19, 1 (2018).
Richter et al. "Phage-assisted evolution of an adenine base editor with improved Cas domain compatibility and activity" Nature Biotechnology, 38(7):883-891 2020.
Schellenberger, V. et al. A recombinant polypeptide extends the in vivo half-life of peptides and proteins in a tunable manner. Nat Biotechnol 27, 1186-1190 (2009).

(Continued)

*Primary Examiner* — Neil P Hammell
*Assistant Examiner* — Tiffany Nicole Grooms
(74) *Attorney, Agent, or Firm* — Myers Bigel, P.A.

(57) ABSTRACT

The invention relates to peptide linkers and fusion proteins comprising linkers designed for optimizing the activity of the proteins comprised therein, and methods for using the same. The invention further relates to newly designed Cas12a-based adenine base editors.

23 Claims, 10 Drawing Sheets

Specification includes a Sequence Listing.

(56) References Cited

OTHER PUBLICATIONS

Stella, S., Alcón, P. & Montoya, G. Structure of the Cpf1 endonuclease R-loop complex after target DNA cleavage. Nature 546, 559 (2017).
Wollacott, A. M., Zanghellini, A., Murphy, P. & Baker, D. Prediction of structures of multidomain proteins from structures of the individual domains. Protein Sci 16, 165-175 (2007).
Yamano, T. et al. Structural Basis for the Canonical and Non-canonical PAM Recognition by CRISPR-Cpf1. Mol Cell 67, (2017).
Zetsche, B. et al. Cpf1 Is a Single RNA-Guided Endonuclease of a Class 2 CRISPR-Cas System. Cell 163, 759-771 (2015).
Bird, R. , et al., "Single-chain antigen-binding proteins", Science, 242:423-426 1988.
Komor, A.C., et al., "Programmable editing of a target base in genomic DNA without double-stranded DNA cleavage", Nature, 533:420-424 2016.
Li, X. , et al., "Base editing with a Cpf1-cytidine deaminase fusion", Nature Biotechnology, 36:324-327 2018.

* cited by examiner

FIG. 1A N-terminus: TadA WT — GS-XTEN-GS — TadA* — L1-L10 — Cas12a

FIG. 1B C-terminus: Cas12a — L11-L24 — TadA — GS-XTEN-GS — TadA*

FIG. 1C C-terminus Reverse dimer: Cas12a — L11-L15 — TadA* — GS-XTEN-GS — TadA WT

OPTIMIZED PROTEIN LINKERS AND METHODS OF USE

STATEMENT OF PRIORITY

This application claims the benefit, under 35 U.S.C. § 119 (e), of U.S. Provisional Application No. 63/054,449 filed on Jul. 21, 2020, the entire contents of which is incorporated by reference herein.

STATEMENT REGARDING ELECTRONIC FILING OF A SEQUENCE LISTING

A Sequence Listing in ASCII text format, submitted under 37 C.F.R. § 1.821, entitled 1499.50_ST25.txt, 722,705 bytes in size, generated on Jul. 14, 2021 and filed via EFS-Web, is provided in lieu of a paper copy. This Sequence Listing is hereby incorporated herein by reference into the specification for its disclosures.

FIELD OF THE INVENTION

The invention relates to peptide linkers and fusion proteins comprising linkers designed for optimizing the activity of the proteins comprised therein, and methods for using the same. The invention further relates to newly designed Cas12a-based adenine base editors.

BACKGROUND OF THE INVENTION

Over the past six years, CRISPR-based gene editing tools (particularly those based on Cas9) have become increasingly popular. While early tools relied on the ability of Cas9 to generate blunt-ended double strand breaks in DNA along with double-strand break repair mechanisms such as homologous recombination and non-homologous end joining, newer methods have been developed that use a modified version of the nuclease primarily as a targeting tool for other covalently linked effector proteins. Notably, the first Cas9-based base editors were developed by linking Cas9 to deaminase domains (see, e.g., Gaudelli et al. *Nature* 551: 464-471 (2017)). The initial cytosine base editor was built by linking a rat APOBEC1 domain (Apolipoprotein B mRNA editing enzyme), which deaminates cytosine to uracil in both RNA and DNA, to the N terminus of Cas9 using a linker based on the previously published unstructured XTEN protein (Komor et al. *Nature* 533(7603): 420-424 (2016). A uracil DNA glycosylase inhibitor (UGI) domain was linked to the C terminus of Cas9 to reduce base excision repair activity. Later versions of the Cas9 cytosine base editors (CBE) doubled the lengths of both linkers by adding flexible glycine and serine residues and added an additional UGI domain. An adenine base editor (ABE) was later developed using the same architecture and linker by removing the UGI domains and replacing the APOBEC1 domain with an *E. coli* TadA (tRNA-specific adenosine deaminase) domain, which typically targets transfer RNA, but which had been evolved to target DNA. The evolved TadA deaminates adenine to form inosine, which base pairs with cytosine during DNA replication leading to A→G or T→C edits. The most recent version of the ABE has been optimized for use in human cells by codon optimization and improved nuclear localization signals.

Cas12a, also known as Cpf1, is a more recently discovered CRISPR endonuclease that has also been used increasingly as a genome editing tool. Cas12a differs from Cas9 in several respects, including, for example, its size, its nuclease activities, the orientation in which the nuclease binds its guide RNA, and the protospacer adjacent motifs (PAMs) that are recognized. However, adenine base editing using Cas12a has not been demonstrated to be successful. Thus, to overcome the short comings in the art, new adenosine base editing tools using Cas12a are needed.

SUMMARY OF THE INVENTION

The current state of the art CRISPR-based adenine base editors are exclusively N-terminal fusions of Cas9 to an evolved TadA heterodimer via a GS-XTEN-GS linker. Although these Cas9-based ABEs edit DNA efficiently, similar fusions to Cas12a have not been found to successfully generate edits. The linker sequence of the Cas9 ABE has not yet been optimized based on the position of the deaminase domains. Furthermore, based on the structural differences between Cas9 and Cas12a, it is likely that the linker sequences and domain architectures useful for Cas9-based ABEs may not be ideal for Cas12a-based ABEs. The present inventors have designed novel linker sequences and optimized the domain architectures for Cas12a-based adenine base editors, which now may allow for targeting of new sites and/or expanding the repertoire of site-specific base editing tools and/or which may be appropriate for commercial use. Also provided are methods of modifying nucleic acids using a fusion protein of the invention and/or a polynucleotide encoding the same. These editors can be used for prokaryotic and/or eukaryotic applications including editing genomes of commercially relevant crops.

One aspect of the invention provides a polypeptide comprising any one of the amino acid sequences of SEQ ID NOs: 1-24 (L1-L24).

A second aspect of the invention provides a polypeptide comprising a Cas12a domain and any one of the amino acid sequences of SEQ ID NOs: 1-24.

A third aspect provides a fusion protein comprising a Cas12a domain, a polypeptide of interest, and any one of the amino acid sequences of SEQ ID NOs: 1-24.

A fourth aspect provides a Type V Clustered Regularly Interspaced Short Palindromic Repeats (CRISPR) associated (Cas) (CRISPR-Cas) system comprising: (a) a fusion protein comprising a Cas12a domain, a linker comprising an amino acid sequence of any one of SEQ ID NOs:1-24, and a polypeptide of interest; wherein the Cas12a domain is linked to the polypeptide of interest via any one of the amino acid sequences of SEQ ID NOs: 1-24, or a nucleic acid encoding the fusion protein; and (b) a guide nucleic acid (CRISPR RNA, CRISPR DNA, crRNA, crDNA, gRNA) comprising a spacer sequence and a repeat sequence, wherein the guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, whereby the system is capable of modifying or modulating the target nucleic acid.

A fifth aspect of the invention provides a fusion protein comprising: (a) a Cas12a domain, wherein the Cas12a domain when in conjunction with a bound guide nucleic acid (e.g., gRNA) specifically binds to a target nucleic acid sequence; (b) a first adenine deaminase domain, (c) a second adenine deaminase domain, wherein the first and second adenine deaminase domains deaminate an adenosine base in a single-stranded portion of the target nucleic acid sequence when in conjunction with the Cas12a domain and the gRNA; and wherein the Cas12a domain is linked to the first adenine deaminase domain or the second adenine deaminases domain via any one of the amino acid sequence of SEQ ID NOs:1-24.

A sixth aspect provides a fusion protein comprising, (a) a first adenine deaminase domain; (b) a second adenine deaminase domain; and (c) a Cas12a (Cpf1) domain, wherein the Cas12a domain comprises a mutation in the nuclease active site, wherein the second adenine deaminase domain is different from the first adenine deaminase domain, the C-terminus of the first adenine deaminase domain is linked to the N-terminus of the second deaminase domain, and the N-terminus of the Cas12a domain is linked to the C-terminus of the second adenine deaminase domain via any one of the amino acid sequences of SEQ ID NOs:1-10 (L1-10).

A seventh aspect provides a fusion protein comprising, (a) a Cas12a (Cpf1) domain; (b) a first adenine deaminase domain; and (c) a second adenine deaminase domain, wherein the second adenine deaminase domain is different from the first adenine deaminase domain, and the C-terminus of the first adenine deaminase domain is linked to the N-terminus of the second deaminase domain and the C-terminus of the Cas12a domain is linked to the N-terminus of the first adenine deaminase domain, and wherein when the first deaminase domain is a wild type adenine deaminase domain, the Cas12a domain is linked to the N-terminus of the first adenine deaminase domain via any one of the amino acid sequences of SEQ ID NOs:11-24 (L11-24), and when the first deaminase domain is a mutated/evolved adenine deaminase domain, the Cas12a domain is linked to the N-terminus of the first adenine deaminase domain via any one of the amino acid sequences of SEQ ID NOs:11-15 (L11-15).

An eighth aspect of the invention provides a method of modifying a target nucleic acid, the method comprising: contacting the target nucleic acid with: (a)(i) a fusion protein of the invention, and (a)(ii) a guide nucleic acid; (b) a complex comprising a fusion protein of the invention and a guide nucleic acid; (c) a composition comprising a fusion protein of the invention and a guide nucleic acid; and/or, (d) a system of the invention, thereby modifying a target nucleic acid.

A ninth aspect of the invention provides a method of modifying a target nucleic acid, the method comprising: contacting a cell or a cell free system comprising the target nucleic acid with: (a)(i) a polynucleotide encoding a polypeptide or fusion protein of the invention, or an expression cassette or vector comprising the same, and (a)(ii) a guide nucleic acid, or an expression cassette or vector comprising the same; and/or (b) a nucleic acid construct encoding a complex comprising a fusion protein of the invention and a guide nucleic acid, or an or an expression cassette or vector comprising the same under conditions wherein the fusion protein is expressed and forms a complex with the guide nucleic acid, the complex hybridizing to the target nucleic acid, thereby modifying a target nucleic acid.

A tenth aspect of the invention provides a method of editing a target nucleic acid, the method comprising: contacting the target nucleic acid with: (a)(i) a fusion protein of the invention, and (a)(ii) a guide nucleic acid; (b) a complex comprising a fusion protein of the invention and a guide nucleic acid; (c)(i) a composition comprising a fusion protein of the invention and (c)(ii) a guide nucleic acid; and/or (d)(i) a system of the invention, wherein the adenine deaminase domain converts an adenosine (A) to a guanine (G) in the target nucleic acid, thereby editing the target nucleic acid to produce a (point) mutation.

An eleventh aspect of the invention provides a method of editing a target nucleic acid, the method comprising: contacting a cell or a cell free system comprising the target nucleic acid with: (a)(i) a polynucleotide encoding a fusion protein of the invention, or an expression cassette or vector comprising the same, and (a)(ii) a guide nucleic acid, or an expression cassette or vector comprising the same; and/or (b) a nucleic acid construct encoding a complex comprising a fusion protein of the invention and a guide nucleic acid, or an or an expression cassette or vector comprising the same under conditions wherein the fusion protein is expressed and forms a complex with the guide nucleic acid, the complex hybridizing to the target nucleic acid, wherein the adenine deaminase domain converts an adenosine (A) to a guanine (G) in the target nucleic acid, thereby editing the target nucleic acid to produce a (point) mutation.

The invention further provides constructs, complexes, compositions, expression cassettes, vectors and cells comprising polypeptides and/or fusion proteins of the invention and/or polynucleotides and nucleic acid constructs encoding the fusion proteins and complexes of the invention.

These and other aspects of the invention are set forth in more detail in the description of the invention below.

BRIEF DESCRIPTION OF THE SEQUENCES

SEQ ID NOs:1-24 are the amino acid sequences of the invention useful for linking polypeptides.

SEQ ID NOs:25-29 are amino acid sequences for exemplary peptide linkers useful for linking polypeptides.

SEQ ID NOs:30-46 are example Cas12a amino acid sequences useful with this invention.

SEQ ID NOs:47-48 and 79-82 are example TadA amino acid sequences useful with this invention.

SEQ ID NOs:49-77 and 90-96 are exemplary fusion proteins.

SEQ ID NOs:83-89 are exemplary spacer sequences.

BRIEF DESCRIPTION OF THE DRAWINGS

FIGS. 1A-C provides exemplary domain arrangements of Cas12a-based adenine base editors of the invention selected for screening. Ten linker designs were selected with the TadA heterodimer fused to the N-terminus of Cpf1 (FIG. 1A), and fourteen were selected with the TadA heterodimer fused to the C-terminus of Cpf1 (FIG. 1B). In addition, five of the fourteen C-terminal linkers (Cterm_1, Cterm_4, Cterm_5, C9R, and Cterm_10) were selected with the order of the TadA and TadA* domains reversed (FIG. 1C). "GS-" is a GS linker including, for example, GS-XTEN-GS.

DETAILED DESCRIPTION

Figure 2:
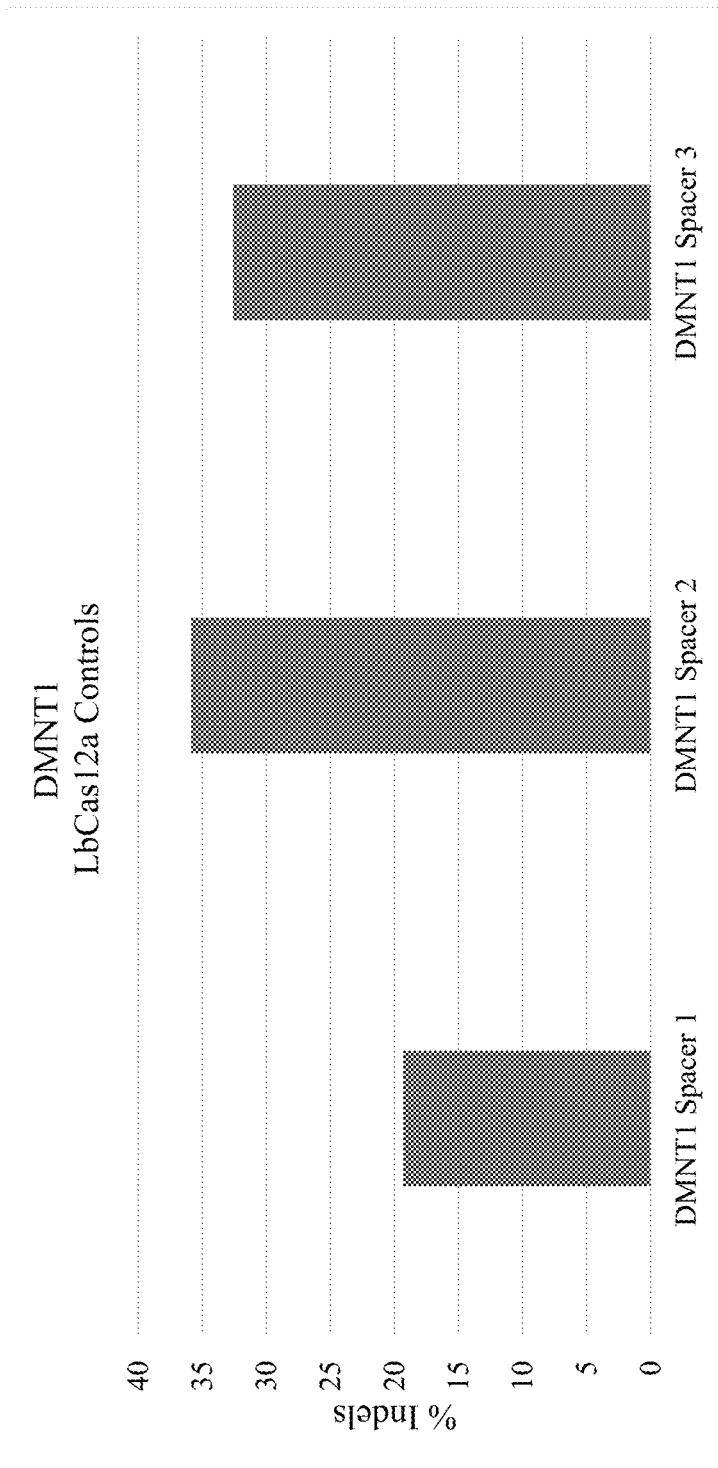
FIG. 2 shows the averaged observed activity of a LbCas12a nuclease at each of the three example spacers in the same experiment.

The present invention now will be described hereinafter with reference to the accompanying drawings and examples, in which embodiments of the invention are shown. This description is not intended to be a detailed catalog of all the different ways in which the invention may be implemented, or all the features that may be added to the instant invention. For example, features illustrated with respect to one embodiment may be incorporated into other embodiments, and features illustrated with respect to a particular embodiment may be deleted from that embodiment. Thus, the invention contemplates that in some embodiments of the invention, any feature or combination of features set forth herein can be excluded or omitted. In addition, numerous variations and additions to the various embodiments suggested herein will be apparent to those skilled in the art in light of the instant disclosure, which do not depart from the instant invention. Hence, the following descriptions are intended to illustrate some particular embodiments of the invention, and not to exhaustively specify all permutations, combinations and variations thereof.

Unless otherwise defined, all technical and scientific terms used herein have the same meaning as commonly understood by one of ordinary skill in the art to which this invention belongs. The terminology used in the description of the invention herein is for the purpose of describing particular embodiments only and is not intended to be limiting of the invention.

All publications, patent applications, patents and other references cited herein are incorporated by reference in their entireties for the teachings relevant to the sentence and/or paragraph in which the reference is presented.

Unless the context indicates otherwise, it is specifically intended that the various features of the invention described herein can be used in any combination. Moreover, the present invention also contemplates that in some embodiments of the invention, any feature or combination of features set forth herein can be excluded or omitted. To illustrate, if the specification states that a composition comprises components A, B and C, it is specifically intended that any of A, B or C, or a combination thereof, can be omitted and disclaimed singularly or in any combination.

As used in the description of the invention and the appended claims, the singular forms "a," "an" and "the" are intended to include the plural forms as well, unless the context clearly indicates otherwise.

Also as used herein, "and/or" refers to and encompasses any and all possible combinations of one or more of the associated listed items, as well as the lack of combinations when interpreted in the alternative ("or").

The term "about," as used herein when referring to a measurable value such as an amount or concentration and the like, is meant to encompass variations of ±10%, ±5%, ±1%, ±0.5%, or even ±0.1% of the specified value as well as the specified value. For example, "about X" where X is the measurable value, is meant to include X as well as variations of ±10%, ±5%, ±1%, ±0.5%, or even ±0.1% of X. A range provided herein for a measureable value may include any other range and/or individual value therein.

As used herein, phrases such as "between X and Y" and "between about X and Y" should be interpreted to include X and Y. As used herein, phrases such as "between about X and Y" mean "between about X and about Y" and phrases such as "from about X to Y" mean "from about X to about Y."

The term "comprise," "comprises" and "comprising" as used herein, specify the presence of the stated features, integers, steps, operations, elements, and/or components, but do not preclude the presence or addition of one or more other features, integers, steps, operations, elements, components, and/or groups thereof.

As used herein, the transitional phrase "consisting essentially of" means that the scope of a claim is to be interpreted to encompass the specified materials or steps recited in the claim and those that do not materially affect the basic and novel characteristic(s) of the claimed invention. Thus, the term "consisting essentially of" when used in a claim of this invention is not intended to be interpreted to be equivalent to "comprising."

As used herein, the terms "increase," "increasing," "increased," "enhance," "enhanced," "enhancing," and "enhancement" (and grammatical variations thereof) describe an elevation of at least about 25%, 50%, 75%, 100%, 150%, 200%, 300%, 400%, 500% or more as compared to a control.

As used herein, the terms "reduce," "reduced," "reducing," "reduction," "diminish," and "decrease" (and grammatical variations thereof), describe, for example, a decrease of at least about 5%, 10%, 15%, 20%, 25%, 35%, 50%, 75%, 80%, 85%, 90%, 95%, 97%, 98%, 99%, or 100% as compared to a control. In particular embodiments, the reduction can result in no or essentially no (i.e., an insignificant amount, e.g., less than about 10% or even 5%) detectable activity or amount.

A "heterologous" or a "recombinant" nucleotide sequence is a nucleotide sequence not naturally associated with a host cell into which it is introduced, including non-naturally occurring multiple copies of a naturally occurring nucleotide sequence.

A "native" or "wild type" nucleic acid, nucleotide sequence, polypeptide or amino acid sequence refers to a naturally occurring or endogenous nucleic acid, nucleotide sequence, polypeptide, or amino acid sequence. Thus, for example, a "wild type mRNA" is an mRNA that is naturally occurring in or endogenous to the organism. A "homologous" nucleic acid sequence is a nucleotide sequence naturally associated with a host cell into which it is introduced.

As used herein, the terms "nucleic acid," "nucleic acid molecule," "nucleotide sequence" and "polynucleotide" refer to RNA or DNA that is linear or branched, single or double stranded, or a hybrid thereof. The term also encompasses RNA/DNA hybrids. When dsRNA is produced synthetically, less common bases, such as inosine, 5-methylcytosine, 6-methyladenine, hypoxanthine and others can also be used for antisense, dsRNA, and ribozyme pairing. For example, polynucleotides that contain C-5 propyne analogues of uridine and cytidine have been shown to bind RNA with high affinity and to be potent antisense inhibitors of gene expression. Other modifications, such as modification to the phosphodiester backbone, or the 2'-hydroxy in the ribose sugar group of the RNA can also be made.

As used herein, the term "nucleotide sequence" refers to a heteropolymer of nucleotides or the sequence of these nucleotides from the 5' to 3' end of a nucleic acid molecule and includes DNA or RNA molecules, including cDNA, a DNA fragment or portion, genomic DNA, synthetic (e.g., chemically synthesized) DNA, plasmid DNA, mRNA, and anti-sense RNA, any of which can be single stranded or double stranded. The terms "nucleotide sequence" "nucleic acid," "nucleic acid molecule," "oligonucleotide" and "polynucleotide" are also used interchangeably herein to refer to a heteropolymer of nucleotides. Nucleic acid molecules and/or nucleotide sequences provided herein are presented herein in the 5' to 3' direction, from left to right and are represented using the standard code for representing the nucleotide characters as set forth in the U.S. sequence rules, 37 CFR §§ 1.821-1.825 and the World Intellectual Property Organization (WIPO) Standard ST.25. A "5' region" as used herein can mean the region of a polynucleotide that is nearest the 5' end of the polynucleotide. Thus, for example, an element in the 5' region of a polynucleotide can be located anywhere from the first nucleotide located at the 5' end of the polynucleotide to the nucleotide located halfway through the polynucleotide. A "3' region" as used herein can mean the region of a polynucleotide that is nearest the 3' end of the polynucleotide. Thus, for example, an element in the 3' region of a polynucleotide can be located anywhere from the first nucleotide located at the 3' end of the polynucleotide to the nucleotide located halfway through the polynucleotide.

As used herein, the term "gene" refers to a nucleic acid molecule capable of being used to produce mRNA, antisense RNA, miRNA, anti-microRNA antisense oligodeoxyribonucleotide (AMO) and the like. Genes may or may not be capable of being used to produce a functional protein or gene product. Genes can include both coding and non-coding regions (e.g., introns, regulatory elements, promoters, enhancers, termination sequences and/or 5' and 3' untranslated regions). A gene may be "isolated" by which is meant a nucleic acid that is substantially or essentially free from components normally found in association with the nucleic acid in its natural state. Such components include other cellular material, culture medium from recombinant production, and/or various chemicals used in chemically synthesizing the nucleic acid.

The term "mutation" refers to point mutations (e.g., missense, or nonsense, or insertions or deletions of single base pairs that result in frame shifts), insertions, deletions, and/or truncations. When the mutation is a substitution of a residue within an amino acid sequence with another residue, or a deletion or insertion of one or more residues within a sequence, the mutations are typically described by identifying the original residue followed by the position of the residue within the sequence and by the identity of the newly substituted residue.

The terms "complementary" or "complementarity," as used herein, refer to the natural binding of polynucleotides under permissive salt and temperature conditions by base-pairing. For example, the sequence "A-G-T" (5' to 3') binds to the complementary sequence "T-C-A" (3' to 5'). Complementarity between two single-stranded molecules may be "partial," in which only some of the nucleotides bind, or it may be complete when total complementarity exists between the single stranded molecules. The degree of complementarity between nucleic acid strands has significant effects on the efficiency and strength of hybridization between nucleic acid strands.

"Complement" as used herein can mean 100% complementarity with the comparator nucleotide sequence or it can mean less than 100% complementarity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, and the like, complementarity).

A "portion" or "fragment" of a nucleotide sequence of the invention will be understood to mean a nucleotide sequence of reduced length relative (e.g., reduced by 1, 2, 3, 4, 5, 6, 7, 8, 9, 10, 11, 12, 13, 14, 15, 16, 17, 18, 19, 20 or more nucleotides) to a reference nucleic acid or nucleotide sequence and comprising, consisting essentially of and/or consisting of a nucleotide sequence of contiguous nucleotides identical or almost identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% identical) to the reference nucleic acid or nucleotide sequence. Such a nucleic acid fragment or portion according to the invention may be, where appropriate, included in a larger polynucleotide of which it is a constituent. As an example, a repeat sequence of guide nucleic acid of this invention may comprise a portion of a wild type Cas12a repeat sequence.

As used herein with respect to polypeptides, the term "fragment" or "portion" may refer to a polypeptide that is reduced in length relative to a reference polypeptide and that comprises, consists essentially of and/or consists of an amino acid sequence of contiguous amino acids identical or almost identical (e.g., 90%, 91%, 92%, 93%, 94%, 95%, 96%, 97%, 98%, 99% identical) to a corresponding portion of the reference polypeptide. Such a polypeptide fragment may be, where appropriate, included in a larger polypeptide of which it is a constituent. In some embodiments, the polypeptide fragment comprises, consists essentially of or consists of at least about 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 100, 125, 150, 175, 200, 225, 250, 260, 270, 280, 290, or more consecutive amino acid residues of a reference polypeptide.

Different nucleic acids or proteins having homology are referred to herein as "homologues." The term homologue includes homologous sequences from the same and other species and orthologous sequences from the same and other species. "Homology" refers to the level of similarity between two or more nucleic acid and/or amino acid sequences in terms of percent of positional identity (e.g., sequence similarity or identity). Homology also refers to the concept of similar functional properties among different nucleic acids or proteins. Thus, the compositions and methods of the invention further comprise homologues to the nucleotide sequences and polypeptide sequences of this invention. "Orthologous," as used herein, refers to homologous nucleotide sequences and/or amino acid sequences in different species that arose from a common ancestral gene during speciation. A homologue of a nucleotide sequence of this invention has a substantial sequence identity (e.g., at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to said nucleotide sequence of the invention.

As used herein "sequence identity" refers to the extent to which two optimally aligned polynucleotide or polypeptide sequences are invariant throughout a window of alignment of components, e.g., nucleotides or amino acids. "Identity" can be readily calculated by known methods including, but not limited to, those described in: Computational Molecular Biology (Lesk, A. M., ed.) Oxford University Press, New York (1988); Biocomputing: Informatics and Genome Projects (Smith, D. W., ed.) Academic Press, New York (1993);

Computer Analysis of Sequence Data, Part I (Griffin, A. M., and Griffin, H. G., eds.) Humana Press, N.J. (1994); Sequence Analysis in Molecular Biology (von Heinje, G., ed.) Academic Press (1987); and Sequence Analysis Primer (Gribskov, M. and Devereux, J., eds.) Stockton Press, New York (1991).

As used herein, the term "percent sequence identity" or "percent identity" refers to the percentage of identical nucleotides in a linear polynucleotide sequence of a reference ("query") polynucleotide molecule (or its complementary strand) as compared to a test ("subject") polynucleotide molecule (or its complementary strand) when the two sequences are optimally aligned. In some embodiments, "percent identity" can refer to the percentage of identical amino acids in an amino acid sequence as compared to a reference polypeptide.

As used herein, the phrase "substantially identical," or "substantial identity" in the context of two nucleic acid molecules, nucleotide sequences or protein sequences, refers to two or more sequences or subsequences that have at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% nucleotide or amino acid residue identity, when compared and aligned for maximum correspondence, as measured using one of the following sequence comparison algorithms or by visual inspection. In some embodiments of the invention, the substantial identity exists over a region of consecutive nucleotides of a nucleotide sequence of the invention that is about 10 nucleotides to about 30 nucleotides, about 15 nucleotides to about 25 nucleotides, about 30 nucleotides to about 40 nucleotides, about 50 nucleotides to about 60 nucleotides, about 70 nucleotides to about 80 nucleotides, about 90 nucleotides to about 100 nucleotides, or more nucleotides in length, and any range therein, up to the full length of the sequence. In some embodiments, the nucleotide sequences can be substantially identical over at least about 20 nucleotides (e.g., about 20, 21, 22, 23, 24, 25, 26, 27, 28, 29, 30, 31, 32, 33, 34, 35, 36, 37, 38, 39, 40 nucleotides). In some embodiments, a substantially identical nucleotide or protein sequence performs substantially the same function as the nucleotide (or encoded protein sequence) to which it is substantially identical.

For sequence comparison, typically one sequence acts as a reference sequence to which test sequences are compared. When using a sequence comparison algorithm, test and reference sequences are entered into a computer, subsequence coordinates are designated if necessary, and sequence algorithm program parameters are designated. The sequence comparison algorithm then calculates the percent sequence identity for the test sequence(s) relative to the reference sequence, based on the designated program parameters.

Optimal alignment of sequences for aligning a comparison window are well known to those skilled in the art and may be conducted by tools such as the local homology algorithm of Smith and Waterman, the homology alignment algorithm of Needleman and Wunsch, the search for similarity method of Pearson and Lipman, and optionally by computerized implementations of these algorithms such as GAP, BESTFIT, FASTA, and TFASTA available as part of the GCG® Wisconsin Package® (Accelrys Inc., San Diego, Calif.). An "identity fraction" for aligned segments of a test sequence and a reference sequence is the number of identical components which are shared by the two aligned sequences divided by the total number of components in the reference sequence segment, e.g., the entire reference sequence or a smaller defined part of the reference sequence. Percent sequence identity is represented as the identity fraction multiplied by 100. The comparison of one or more polynucleotide sequences may be to a full-length polynucleotide sequence or a portion thereof, or to a longer polynucleotide sequence. For purposes of this invention "percent identity" may also be determined using BLASTX version 2.0 for translated nucleotide sequences and BLASTN version 2.0 for polynucleotide sequences.

Two nucleotide sequences may also be considered substantially complementary when the two sequences hybridize to each other under stringent conditions. In some representative embodiments, two nucleotide sequences considered to be substantially complementary hybridize to each other under highly stringent conditions.

"Stringent hybridization conditions" and "stringent hybridization wash conditions" in the context of nucleic acid hybridization experiments such as Southern and Northern hybridizations are sequence dependent and are different under different environmental parameters. An extensive guide to the hybridization of nucleic acids is found in Tijssen Laboratory Techniques in Biochemistry and Molecular Biology-Hybridization with Nucleic Acid Probes part I chapter 2 "Overview of principles of hybridization and the strategy of nucleic acid probe assays" Elsevier, New York (1993). Generally, highly stringent hybridization and wash conditions are selected to be about 5° C. lower than the thermal melting point ($T_m$) for the specific sequence at a defined ionic strength and pH.

The $T_m$ is the temperature (under defined ionic strength and pH) at which 50% of the target sequence hybridizes to a perfectly matched probe. Very stringent conditions are selected to be equal to the $T_m$ for a particular probe. An example of stringent hybridization conditions for hybridization of complementary nucleotide sequences which have more than 100 complementary residues on a filter in a Southern or northern blot is 50% formamide with 1 mg of heparin at 42° C., with the hybridization being carried out overnight. An example of highly stringent wash conditions is 0.1 5M NaCl at 72° C. for about 15 minutes. An example of stringent wash conditions is a 0.2×SSC wash at 65° C. for 15 minutes (see, Sambrook, infra, for a description of SSC buffer). Often, a high stringency wash is preceded by a low stringency wash to remove background probe signal. An example of a medium stringency wash for a duplex of, e.g., more than 100 nucleotides, is 1×SSC at 45° C. for 15 minutes. An example of a low stringency wash for a duplex of, e.g., more than 100 nucleotides, is 4-6×SSC at 40° C. for 15 minutes. For short probes (e.g., about 10 to 50 nucleotides), stringent conditions typically involve salt concentrations of less than about 1.0 M Na ion, typically about 0.01 to 1.0 M Na ion concentration (or other salts) at pH 7.0 to 8.3, and the temperature is typically at least about 30° C. Stringent conditions can also be achieved with the addition of destabilizing agents such as formamide. In general, a signal to noise ratio of 2× (or higher) than that observed for an unrelated probe in the particular hybridization assay indicates detection of a specific hybridization. Nucleotide sequences that do not hybridize to each other under stringent conditions are still substantially identical if the proteins that they encode are substantially identical. This can occur, for example, when a copy of a nucleotide sequence is created using the maximum codon degeneracy permitted by the genetic code.

Any nucleotide sequence, polynucleotide and/or recombinant nucleic acid construct of this invention can be codon optimized for expression in any organism of interest. Codon optimization is well known in the art and involves modification of a nucleotide sequence for codon usage bias using species specific codon usage tables. The codon usage tables are generated based on a sequence analysis of the most highly expressed genes for the organism/species of interest. When the nucleotide sequences are to be expressed in the nucleus, the codon usage tables are generated based on a sequence analysis of highly expressed nuclear genes for the species of interest. The modifications of the nucleotide sequences are determined by comparing the species-specific codon usage table with the codons present in the native polynucleotide sequences. As is understood in the art, codon optimization of a nucleotide sequence results in a nucleotide sequence having less than 100% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, or 99.9%, and any range or value therein) to the native nucleotide sequence but which still encodes a polypeptide having the same function as that encoded by the original, native nucleotide sequence. Thus, in some embodiments of the invention, the polynucleotides, nucleic acid constructs, expression cassettes, and/or vectors of the invention (comprising/encoding the polypeptides, fusion proteins, complexes of the invention, e.g., Cas12a, polypeptide of interest, adenine deaminase, linkers) may be codon optimized for expression in a particular species of interest, e.g., a particular plant species, a particular bacterial species, a particular animal species, and the like. In some embodiments, the codon optimized polynucleotides, nucleic acid constructs, expression cassettes, and/or vectors of the invention have about 70% to about 99.9% (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5%, 99.9% or 100%) identity or more to the polynucleotides, nucleic acid constructs, expression cassettes, and/or vectors of the invention not having been codon optimized.

In any of the embodiments described herein, a polynucleotide or nucleic acid construct of the invention may be operatively associated with a variety of promoters and other regulatory elements for expression in an organism of interest and/or a cell of an organism of interest. Thus, in some embodiments, an expression cassette or vector comprising a polynucleotide or nucleic acid construct of the invention may further comprise one or more promoters, enhancers, and/or terminators operably linked to the one or more polynucleotides or nucleic acid constructs.

By "operably linked" or "operably associated" as used herein, it is meant that the indicated elements are functionally related to each other and are also generally physically related. Thus, the term "operably linked" or "operably associated" as used herein, refers to nucleotide sequences on a single nucleic acid molecule that are functionally associated. Thus, a first nucleotide sequence that is operably linked to a second nucleotide sequence means a situation when the first nucleotide sequence is placed in a functional relationship with the second nucleotide sequence. For instance, a promoter is operably associated with a nucleotide sequence if the promoter effects the transcription or expression of said nucleotide sequence. Those skilled in the art will appreciate that the control sequences (e.g., promoter) need not be contiguous with the nucleotide sequence to which it is operably associated, as long as the control sequences function to direct the expression thereof. Thus, for example, intervening untranslated, yet transcribed, sequences can be present between a promoter and a nucleotide sequence, and the promoter can still be considered "operably linked" to the nucleotide sequence.

As used herein, the term "linked," in reference to polypeptides, refers to the attachment of one polypeptide to another. A polypeptide may be linked to another polypeptide (at the N-terminus or the C-terminus) directly (e.g., via a peptide bond) or through a linker.

The term "linker" is art-recognized and refers to a bond, a chemical group, or a molecule linking two molecules or moieties, e.g., two domains of a fusion protein, such as, for example, a Cas12a domain and a nucleic acid-editing domain (e.g., an adenosine deaminase). A linker may be comprised of a single linking molecule or may comprise more than one linking molecule (e.g., an amino acid). In some embodiments, the linker can be an organic molecule, group, polymer, or chemical moiety. In some embodiments, the linker may be an amino acid or a peptide linker. In some embodiments, a peptide linker may be about 4 to 100 or more amino acids in length, for example, 4, 5, 6, 7, 8, 9, 10, 11, 12, 13, 14, 15, 16, 17, 18, 19, 20, 21, 22, 23, 24, 25, 26, 27, 28, 29, 30, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids in length. In some embodiments, a peptide linker may be a GS linker. In some embodiments, the linker may comprise the amino acid sequence SGGS (SEQ ID NO:25), (GGS)n, or S(GGS)n (one or more repeats of SEQ ID NO:26), wherein n is 1-20 (e.g., 1, 2, 3, 4, 5, 6, 7, 8, 9, 10, 11, 12, 13, 14, 15, 16, 17, 18, 19, 20, and any range or value therein). In some embodiments, the linker may comprise the amino acid sequence SGGSGGSGGS (SEQ ID NO:27). In some embodiments, the linker may comprise the amino acid sequence, SGSETPGTSESATPES (SEQ ID NO:28), also referred to as the XTEN linker. In some embodiments, a linker may comprise the amino acid sequence SGGSSGGSSGSETPGTSESATPESSGGSSGGS (SEQ ID NO:29), also referred to as the GS-XTEN-GS linker. In some embodiments, a linker comprises, consists essentially of, or consists of any one of the amino acid sequences of SEQ ID NOs:1-24.

A "promoter" is a nucleotide sequence that controls or regulates the transcription of a nucleotide sequence (e.g., a coding sequence) that is operably associated with the promoter.

The coding sequence controlled or regulated by a promoter may encode a polypeptide and/or a functional RNA. Typically, a "promoter" refers to a nucleotide sequence that contains a binding site for RNA polymerase II and directs the initiation of transcription. In general, promoters are found 5', or upstream, relative to the start of the coding region of the corresponding coding sequence. The promoter region may comprise other elements that act as regulators of gene expression. These include a TATA box consensus sequence, and often a CAAT box consensus sequence (Breathnach and Chambon, (1981) Annu. Rev. Biochem. 50:349). In plants, the CAAT box may be substituted by the AGGA box (Messing et al., (1983) in Genetic Engineering of Plants, T. Kosuge, C. Meredith and A. Hollaender (eds.), Plenum Press, pp. 211-227).

Promoters can include, for example, constitutive, inducible, temporally regulated, developmentally regulated, chemically regulated, tissue-preferred and/or tissue-specific promoters for use in the preparation of recombinant nucleic acid molecules, e.g., "synthetic nucleic acid constructs" or "protein-RNA complex." These various types of promoters are known in the art.

The choice of promoter may vary depending on the temporal and spatial requirements for expression, and also may vary based on the host cell to be transformed. Promoters for many different organisms are well known in the art. Based on the extensive knowledge present in the art, the appropriate promoter can be selected for the particular host organism of interest. Thus, for example, much is known about promoters upstream of highly constitutively expressed genes in model organisms and such knowledge can be readily accessed and implemented in other systems as appropriate.

In some embodiments, a polynucleotide and/or a nucleic acid construct of the invention can be an "expression cassette" or can be comprised within an expression cassette. As used herein, "expression cassette" means a recombinant nucleic acid molecule comprising, for example, a nucleic acid construct of the invention (e.g., encoding a complex of the invention (e.g., a fusion protein of the invention and guide nucleic acid)), wherein the nucleic acid construct is operably associated with at least a control sequence (e.g., a promoter). Thus, some embodiments of the invention provide expression cassettes designed to express, for example, a nucleic acid construct of the invention.

An expression cassette comprising a nucleotide sequence of interest may be chimeric, meaning that at least one of its components is heterologous with respect to at least one of its other components (e.g., a promoter from the host organism operably linked to a polynucleotide of interest to be expressed in the host organism, wherein the polynucleotide of interest is from a different organism than the host or is not normally found in association with that promoter). An expression cassette may also be one that is naturally occurring but has been obtained in a recombinant form useful for heterologous expression.

An expression cassette may optionally include a transcriptional and/or translational termination region (i.e., termination region) and/or an enhancer region that is functional in the selected host cell. A variety of transcriptional terminators and/or enhancers are available for use in expression cassettes and are responsible for the termination of transcription and correct mRNA polyadenylation. The termination region and/or enhancer region may be native to the operably linked nucleotide sequence of interest, may be native to the host cell, or may be from another source (e.g., foreign or heterologous to the promoter, to the nucleotide sequence of interest, to the host, or any combination thereof).

An expression cassette of the invention also can include a nucleotide sequence encoding a selectable marker, which can be used to select a transformed host cell. As used herein, "selectable marker" means a nucleotide sequence that when expressed imparts a distinct phenotype to the host cell expressing the marker and thus allows such transformed cells to be distinguished from those that do not have the marker. Such a nucleotide sequence may encode either a selectable or screenable marker, depending on whether the marker confers a trait that can be selected for by chemical means, such as by using a selective agent (e.g., an antibiotic and the like), or on whether the marker is simply a trait that one can identify through observation or testing, such as by screening (e.g., fluorescence). Many examples of suitable selectable markers are known in the art and can be used in the expression cassettes described herein.

In addition to expression cassettes, the nucleic acid molecules/constructs and polynucleotide sequences described herein can be used in connection with vectors. The term "vector" refers to a composition for transferring, delivering, or introducing a nucleic acid (or nucleic acids) into a cell. A vector comprises a nucleic acid molecule comprising the nucleotide sequence(s) to be transferred, delivered, or introduced. Vectors for use in transformation of host organisms are well known in the art. Non-limiting examples of general classes of vectors include but are not limited to a viral vector, a plasmid vector, a phage vector, a phagemid vector, a cosmid vector, a fosmid vector, a bacteriophage, an artificial chromosome, minicircle, or an *Agrobacterium* binary vector in double or single stranded linear or circular form which may or may not be self-transmissible or mobilizable. In some embodiments, a viral vector can include, but is not limited to, a retroviral, lentiviral, adenoviral, adeno-associated, or herpes simplex viral vector. A vector as defined herein can transform a prokaryotic or eukaryotic host either by integration into the cellular genome or exist extrachromosomally (e.g., autonomous replicating plasmid with an origin of replication). Additionally, included are shuttle vectors by which is meant a DNA vehicle capable, naturally or by design, of replication in two different host organisms, which may be selected from actinomycetes and related species, bacteria and eukaryotic (e.g., higher plant, mammalian, yeast or fungal cells). In some embodiments, the nucleic acid in the vector is under the control of, and operably linked to, an appropriate promoter or other regulatory elements for transcription in a host cell. The vector may be a bi-functional expression vector which functions in multiple hosts. In the case of genomic DNA, this may contain its own promoter or other regulatory elements and in the case of cDNA this may be under the control of an appropriate promoter or other regulatory elements for expression in the host cell. Accordingly, a polynucleotide and a nucleic acid construct of this invention, and/or expression cassettes comprising the same may be comprised in vectors as described herein and as known in the art.

As used herein, "contact", contacting", "contacted," and grammatical variations thereof, refers to placing the components of a desired reaction together under conditions suitable for carrying out the desired reaction (e.g., transformation, transcriptional control, genome editing, nicking, and/or cleavage). Thus, for example, a target nucleic acid may be contacted with a fusion protein of the invention and a guide nucleic acid, thereby modifying the target nucleic acid. In some embodiments, a target DNA may be contacted with a polynucleotide or nucleic acid construct encoding a fusion protein of the invention and a guide nucleic acid under conditions wherein the fusion protein is expressed and forms a complex with the guide nucleic acid, with the complex then hybridizing to the target nucleic acid to modify the target nucleic acid.

As used herein, "modifying" or "modification" in reference to a target nucleic acid includes editing (e.g., mutating), covalent modification, exchanging/substituting nucleic acids/nucleotide bases, deleting, cleaving, nicking, and/or transcriptional control of a target nucleic acid.

"Introducing," "introduce," "introduced" (and grammatical variations thereof) in the context of a polynucleotide of interest means presenting a nucleotide sequence of interest (e.g., polynucleotide, a nucleic acid construct, a complex (e.g., protein-RNA chimeric complex), and/or a guide nucleic acid) to a host organism or cell of said organism (e.g., host cell) in such a manner that the nucleotide sequence gains access to the interior of a cell. Thus, for example, a polynucleotide encoding a fusion protein of the invention and guide nucleic acid may be introduced into a cell of an organism, thereby transforming the cell.

The term "transformation" as used herein refers to the introduction of a heterologous nucleic acid into a cell. Transformation of a cell may be stable or transient. Thus, in some embodiments, a host cell or host organism is stably transformed with a nucleic acid molecule of the invention. In other embodiments, a host cell or host organism is transiently transformed with a recombinant nucleic acid molecule of the invention.

"Transient transformation" in the context of a polynucleotide means that a polynucleotide is introduced into the cell and does not integrate into the genome of the cell.

By "stably introducing" or "stably introduced" in the context of a polynucleotide introduced into a cell is intended that the introduced polynucleotide is stably incorporated into the genome of the cell, and thus the cell is stably transformed with the polynucleotide.

"Stable transformation" or "stably transformed" as used herein means that a nucleic acid molecule is introduced into a cell and integrates into the genome of the cell. As such, the integrated nucleic acid molecule is capable of being inherited by the progeny thereof, more particularly, by the progeny of multiple successive generations. "Genome" as used herein includes the nuclear and the plastid genome, and therefore includes integration of the nucleic acid into, for example, the chloroplast or mitochondrial genome. Stable transformation as used herein can also refer to a transgene that is maintained extrachromasomally, for example, as a minichromosome or a plasmid.

Transient transformation may be detected by, for example, an enzyme-linked immunosorbent assay (ELISA) or Western blot, which can detect the presence of a peptide or polypeptide encoded by one or more transgene introduced into an organism. Stable transformation of a cell can be detected by, for example, a Southern blot hybridization assay of genomic DNA of the cell with nucleic acid sequences which specifically hybridize with a nucleotide sequence of a transgene introduced into an organism (e.g., a plant). Stable transformation of a cell can be detected by, for example, a Northern blot hybridization assay of RNA of the cell with nucleic acid sequences which specifically hybridize with a nucleotide sequence of a transgene introduced into a host organism. Stable transformation of a cell can also be detected by, e.g., a polymerase chain reaction (PCR) or other amplification reactions as are well known in the art, employing specific primer sequences that hybridize with target sequence(s) of a transgene, resulting in amplification of the transgene sequence, which can be detected according to standard methods Transformation can also be detected by direct sequencing and/or hybridization protocols well known in the art.

Accordingly, in some embodiments, the nucleotide sequences, nucleic acid constructs, and/or expression cassettes of the invention may be expressed transiently and/or they may be stably incorporated into the genome of the host organism. Thus, in some embodiments, a fusion protein of the invention or polynucleotide encoding the same may be introduced into a cell with a guide nucleic acid and as such no DNA maintained in the cell.

A nucleic acid construct/polynucleotide of the invention can be introduced into a cell by any method known to those of skill in the art. In some embodiments of the invention, transformation of a cell comprises nuclear transformation. In other embodiments, transformation of a cell comprises plastid transformation (e.g., chloroplast transformation). In still further embodiments, a nucleic acid construct/polynucleotide of the invention can be introduced into a cell via conventional breeding techniques.

Procedures for transforming both eukaryotic and prokaryotic organisms are well known and routine in the art and are described throughout the literature (See, for example, Jiang et al. 2013. Nat. Biotechnol. 31:233-239; Ran et al. *Nature Protocols* 8:2281-2308 (2013)).

A nucleotide sequence therefore can be introduced into a host organism or its cell in any number of ways that are well known in the art. The methods of the invention do not depend on a particular method for introducing one or more nucleotide sequences into the organism, only that they gain access to the interior of at least one cell of the organism. Where more than one nucleotide sequence is to be introduced, they can be assembled as part of a single nucleic acid construct, or as separate nucleic acid constructs, and can be located on the same or different nucleic acid constructs. Accordingly, the nucleotide sequences can be introduced into the cell of interest in a single transformation event, or in separate transformation events, or, alternatively, where relevant, a nucleotide sequence can be incorporated into a plant, for example, as part of a breeding protocol.

The present invention is directed to polypeptides (e.g., SEQ ID NOs:1-24) that may be used, for example, to link two or more proteins/protein domains. In some embodiments, a polypeptide of the invention may be about 70% to 100% identical (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100% identical) to any one of the amino acid sequences of SEQ ID NOs:1-24. In some embodiments, the invention provides polynucleotides encoding any one of the amino acid sequences of SEQ ID NOs:1-24 and/or polynucleotides having 70% to 100% identity (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the polynucleotides encoding any one of the amino acid sequences of SEQ ID NOs:1-24. In some embodiments, the polynucleotides encoding any one of the amino acid sequences of SEQ ID NOs:1-24 may be codon optimized for expression in an organism.

The present invention is also directed to synthetic fusion proteins comprising these polypeptides. In some embodiments, the invention provides polypeptides comprising any one of the amino acid sequences of SEQ ID NOs: 1-24 and a polypeptide of interest. In some embodiments, a polypeptide of interest may be linked at its C-terminus and/or its N-terminus to any one of the amino acid sequences of SEQ ID NOs: 1-24, optionally at the C-terminus or the N-terminus. In some embodiments, a polypeptide of interest may comprise two or more polypeptides of interest (e.g., 2, 3, 4, 5, 6, 7 or more), which may be the same or different, wherein at least two of the two or more polypeptides of interest may be linked to one another via any one of the amino acid sequences of SEQ ID NOs: 1-24.

A polypeptide of interest useful with this invention can include, but is not limited to, a polypeptide or protein domain having deaminase (deamination) activity (e.g., cytosine deaminase, adenine deaminase), nickase activity, recombinase activity, transposase activity, methylase activity, glycosylase (DNA glycosylase) activity, glycosylase inhibitor activity (e.g., uracil-DNA glycosylase inhibitor (UGI). demethylase activity, transcription activation activity, transcription repression activity, transcription release factor activity, histone modification activity, nuclease activity, single-strand RNA cleavage activity, double-strand RNA cleavage activity, restriction endonuclease activity (e.g., Fok1), nucleic acid binding activity, methyltransferase activity, DNA repair activity, DNA damage activity, dismutase activity, alkylation activity, depurination activity, oxidation activity, pyrimidine dimer forming activity, integrase activity, transposase activity, polymerase activity, ligase activity, helicase activity, and/or photolyase activity. In some embodiments, the polypeptide of interest is an adenine deaminase, cytosine deaminase, a Fok1 nuclease, or a uracil-DNA glycosylase inhibitor. In some embodiments, a polynucleotide of interest may be codon optimized for expression in an organism.

In some embodiments, the polypeptide of interest is a CRISPR Cas12a polypeptide or Cas12a domain, wherein the Cas12a is linked at its C-terminus and/or N-terminus to the C-terminus or N-terminus of any one of the amino acid sequences of SEQ ID NOs: 1-24.

In some embodiments, a fusion protein is provided comprising a Cas12a, a polypeptide of interest, and any one of the amino acid sequences of SEQ ID NOs: 1-24. In some embodiments, the amino acid sequences of SEQ ID NOs: 1-24 enable optimal placement of Cas12a and one or more (e.g., 1, 2, 3, 4, 5, 6, 7 or more) polypeptides of interest (e.g., adenine deaminase domains, e.g., TadA/TadA*) relative to the Cas12a domain. The amino acid sequences of SEQ ID NOs:1-24 may be used to link a Cas12a and polypeptide of interest(s) in a manner that allows access to the single-stranded portion of the non-target strand for, e.g., nucleic acid modification, e.g., base editing.

In some embodiments, the amino acid sequences of SEQ ID NOs: 1-24 when used to link Cas12a with a polypeptide of interest may provide different windows for modifying or editing of nucleic acids. For example, the amino acid sequences of SEQ ID NOs: 1-24 linking a polypeptide of interest to Cas12a may provide a window for editing or modifying of 1 to about 25 nucleotides from a corresponding PAM (protospacer adjacent motif) in a target nucleic acid (e.g., DNA) (e.g., an editing/modifying window of 1, 2, 3, 4, 5, 6, 7, 8, 9, 10, 11, 12, 13, 14, 15, 16, 17, 18, 19, 20, 21, 22, 23, 24, or 25 nucleotides from the PAM and any range or value therein). In some embodiments, an editing or modifying window may be 1, 2, 3, 4, 5, 6, 7, 8, 9, 10, to about 11, 12, 13, 14, 15, 16, 17, 18, 19, 20, 21, 22, 23, 24, 25 nucleotides from a PAM (e.g., 1 to 20, 1 to 15, 1 to 10, 3 to 15, 4 to 10, 5 to 25, 5 to 20, 5 to 15, 5 to 10, 7 to 15 nucleotides and the like, from the PAM).

Cas12a is a Type V Clustered Regularly Interspaced Short Palindromic Repeats (CRISPR)-Cas nuclease. Cas12a differs in several respects from the more well-known Type II CRISPR Cas9 nuclease. For example, Cas9 recognizes a G-rich protospacer-adjacent motif (PAM) that is 3' to its guide RNA (gRNA, sgRNA) binding site (protospacer, target nucleic acid, target DNA) (3'-NGG), while Cas12a recognizes a T-rich PAM that is located 5' to the target nucleic acid (5'-ttN, 5'TTTN). In fact, the orientations in which Cas9 and Cas12a bind their guide RNAs are very nearly reversed in relation to their N and C termini. Furthermore, Cas12a enzymes use a single guide RNA (gRNA, CRISPR array, crRNA) rather than the dual guide RNA (sgRNA (e.g., crRNA and tracrRNA)) found in natural Cas9 systems, and Cas12a processes its own gRNAs. Additionally, Cas12a nuclease activity produces staggered DNA double stranded breaks instead of blunt ends produced by Cas9 nuclease activity, and Cas12a relies on a single RuvC domain to cleave both DNA strands, whereas Cas9 utilizes an HNH domain and a RuvC domain for cleavage.

A CRISPR Cas12a polypeptide or CRISPR Cas12a domain useful with this invention may be any known or later identified Cas12a nuclease (previously known as Cpf1) (see, e.g., U.S. Pat. No. 9,790,490, which is incorporated by reference for its disclosures of Cpf1 (Cas12a) sequences). The term "Cas12a", "Cas12a polypeptide" or "Cas12a domain" refers to an RNA-guided nuclease comprising a Cas12a polypeptide, or a fragment thereof, which comprises the guide nucleic acid binding domain of Cas12a and/or an active, inactive, or partially active DNA cleavage domain of Cas12a. In some embodiments, a Cas12a useful with the invention may comprise a mutation in the nuclease active site (e.g., RuvC site of the Cas12a domain). A Cas12a domain or Cas12a polypeptide having a mutation in its nuclease active site, and therefore, no longer comprising nuclease activity, is commonly referred to as deadCas12a (e.g., dCas12a). In some embodiments, a Cas12a domain or Cas12a polypeptide having a mutation in its nuclease active site may have impaired activity.

In some embodiments, a Cas12a domain can include, but is not limited to, the amino acid sequence of any one of SEQ ID NOs:30-46 (e.g., SEQ ID NOs:30, 31, 32, 33, 34, 35, 36, 37, 38, 39, 40, 41, 42, 43, 44, 45, 46); or a polynucleotide encoding the same. In some embodiments, a fusion protein of the invention may comprise a Cas12a domain from Lachnospiraceae bacterium ND2006 Cas12a (LbCas12a) (e.g., SEQ ID NO:30).

In some embodiments, a polynucleotide encoding the Cas12a domain may be codon optimized for expression in an organism. Thus, in some embodiments, the invention provides a polynucleotide having at least about 70% identity (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 100% identity) to a polynucleotide encoding the amino acid sequence of any one of SEQ ID NOs:30-46.

In some embodiments, a Type V Clustered Regularly Interspaced Short Palindromic Repeats (CRISPR)-associated (Cas) (CRISPR-Cas) system is provided, the system comprising: (a) a fusion protein comprising a Cas12a domain, a linker comprising any one of the amino acid sequences of SEQ ID NOs: 1-24, and a polypeptide of interest, or a nucleic acid encoding the fusion protein; wherein the Cas12a domain is linked to the polypeptide of interest via any one of the amino acid sequences of SEQ ID NOs: 1-24; and (b) a guide nucleic acid (CRISPR RNA, CRISPR DNA, crRNA, crDNA) comprising a spacer sequence and a repeat sequence, wherein the guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, whereby the system is capable of modifying (e.g., cleaving or editing) or modulating (e.g., modulating transcription) the target nucleic acid.

In some embodiments, a fusion protein is provided comprising a Cas12a, a polypeptide of interest, and any one of the amino acid sequences of SEQ ID NOs: 1-24 wherein the polypeptide of interest is an adenine deaminase polypeptide or domain.

In some embodiments, the present invention provides a fusion protein comprising: (a) a Cas12a domain, wherein the Cas12a domain when in conjunction with a bound guide nucleic acid (e.g., gRNA) specifically binds to a target nucleic acid sequence; (b) a first adenine deaminase domain, (c) a second adenine deaminase domain, wherein the first and second adenine deaminase domains deaminate an adenosine base in a single-stranded portion of the target nucleic acid sequence when in conjunction with the Cas12a domain and the gRNA; and wherein the Cas12a domain is linked to the first adenine deaminase domain or the second adenine deaminases domain via any one of the amino acid sequence of SEQ ID NOs:1-24. In some embodiments, the N-terminus of the Cas12a domain may be linked to the C-terminus of the second adenine deaminase domain via any one of the amino acid sequences of SEQ ID NOs:1-10, or the C-terminus of the Cas12a domain may be linked to the N-terminus of the first adenine deaminase domain or the second adenine deaminases domain via any one of the amino acid sequences of SEQ ID NOs:11-24. In some embodiments, the first adenine deaminase is a wild type adenine deaminase (e.g., TadA (tRNA-specific adenosine deaminase; (e.g., SEQ ID NO:47)) and the second adenine deaminase domain is a mutated/evolved adenine deaminase domain (e.g., TadA* (evolved tRNA-specific adenosine deaminase; e.g., SEQ ID NOs:48 or 78-82)) and the C-terminus of the Cas12a domain is linked to the N-terminus of the second adenine deaminase domain via any one of the amino acid sequences of SEQ ID NOs:11-15 or to the N-terminus of the first adenine deaminase domain via any one of the amino acid sequences of SEQ ID NOs:11-24; or the N-terminus of the Cas12a domain is linked to the C-terminus of the second adenine deaminase domain via any one of the amino acid sequences of SEQ ID NOs:1-10. Exemplary fusion proteins of the present invention include, but are not limited to, the amino acid sequences of SEQ ID NOs:49-77 and/or SEQ ID NOs:90-96.

In some embodiments, a fusion protein is provided comprising: (a) a first adenine deaminase domain; (b) a second adenine deaminase domain; and (c) a Cas12a (Cpf1) domain, wherein the Cas12a domain comprises a mutation in the nuclease active site, wherein the second adenine deaminase domain is different from the first adenine deaminase domain, the C-terminus of the first adenine deaminase domain is linked to the N-terminus of the second deaminase domain, and the N-terminus of the Cas12a domain is linked to the C-terminus of the second adenine deaminase domain via any one of the amino acid sequences of SEQ ID NOs:1-10 (L1-10). In some embodiments, the first adenine deaminase is a wild type adenine deaminase (e.g., TadA) (e.g., SEQ ID NO:47) and the second adenine deaminase domain is a mutated/evolved adenine deaminase domain (e.g., TadA*) (e.g., SEQ ID NOs:48 or 78-82). In some embodiments, a fusion protein is provided comprising any one of the amino acid sequences of SEQ ID NOs:49-77 and/or SEQ ID NOs:90-96.

In some embodiments, a fusion protein is provided comprising: (a) a Cas12a domain; (b) a first adenine deaminase domain; and (c) a second adenine deaminase domain, wherein the second adenine deaminase domain is different from the first adenine deaminase domain, and the C-terminus of the first adenine deaminase domain is linked to the N-terminus of the second deaminase domain and the C-terminus of the Cas12a domain is linked to the N-terminus of the first adenine deaminase domain, and wherein when the first deaminase domain is a wild type adenine deaminase domain, the Cas12a domain is linked to the N-terminus of the first adenine deaminase domain via any one of the amino acid sequences of SEQ ID NOs:11-24 (L11-24), and when the first deaminase domain is a mutated/evolved adenine deaminase domain, the Cas domain is linked to the N-terminus of the first adenine deaminase domain via any one of the amino acid sequences of SEQ ID NOs:11-15 (L11-15). In some embodiments, the first adenine deaminase domain is a wild type adenosine deaminase (e.g., a wild type tRNA-specific adenosine deaminase domain) or a mutated/evolved adenosine deaminase domain (e.g., mutated/evolved tRNA-specific adenosine deaminase domain) (e.g., SEQ ID NOs:47, 48 or 78-82). In some embodiments, the second adenine deaminase domain is a wild type adenosine deaminase (e.g., a wild type tRNA-specific adenosine deaminase domain) or a mutated/evolved adenosine deaminase domain (e.g., mutated/evolved tRNA-specific adenosine deaminase domain) (e.g., SEQ ID NOs: 47, 48 or 78-82). In some embodiments, a first adenine deaminase and a second adenine deaminase form a dimer. In some embodiments, a fusion protein is provided comprising any one of the amino acid sequences of SEQ ID NOs:49-77 and/or 90-96.

An adenine deaminase (or adenosine deaminase) useful with this invention may be any known or later identified adenine deaminase from any organism (see, e.g., U.S. Pat. No. 10,113,163, which is incorporated by reference herein for its disclosure of adenine deaminases). An "adenine deaminase" and "adenosine deaminase" as used herein refer to a polypeptide or domain thereof that catalyzes or is capable of catalyzing the hydrolytic deamination (e.g., removal of an amine group from adenine) of adenine or adenosine. In some embodiments, an adenine deaminase may catalyze the hydrolytic deamination of adenosine or deoxyadenosine to inosine or deoxyinosine, respectively. In some embodiments, the adenosine deaminase catalyzes the hydrolytic deamination of adenine or adenosine in DNA. In some embodiments, an adenine deaminase encoded by a nucleic acid construct of the invention may generate an A→G conversion in the sense (e.g., "+"; template) strand of the target nucleic acid or a T→C conversion in the antisense (e.g., "−", complementary) strand of the target nucleic acid. An adenine deaminase useful with this invention may be any known or later identified adenine deaminase from any organism (see, e.g., U.S. Pat. No. 10,113,163, which is incorporated by reference herein for its disclosure of adenine deaminases).

In some embodiments, an adenosine deaminase may be a variant of a naturally occurring adenine deaminase. Thus, in some embodiments, an adenosine deaminase useful with the invention may be about 70% to 100% identical to a wild type adenine deaminase (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or 100% identical to a naturally occurring adenine deaminase). In some embodiments, the deaminase or deaminase does not occur in nature and may be referred to as an engineered, mutated or evolved adenosine deaminase. Thus, for example, an engineered, mutated or evolved adenine deaminase polypeptide or an adenine deaminase domain may be about 70% to 99.9% identical to a naturally occurring adenine deaminase polypeptide/domain (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% identical to a naturally occurring adenine deaminase polypeptide or adenine deaminase domain). In some embodiments, the adenosine deaminase is from a bacterium, (e.g., *Escherichia coli, Staphylococcus aureus, Haemophilus influenzae, Caulobacter crescentus*, and the like). In some embodiments, a polynucleotide encoding an adenine deaminase polypeptide/domain may be codon optimized for expression in an organism (e.g., a plant).

In some embodiments, an adenine deaminase domain may be a wild type tRNA-specific adenosine deaminase domain, e.g., a tRNA-specific adenosine deaminase (TadA) and/or a mutated/evolved adenosine deaminase domain, e.g., mutated/evolved tRNA-specific adenosine deaminase domain (TadA*). In some embodiments, a TadA domain may be from E. coli. In some embodiments, the TadA may be modified, e.g., truncated, missing one or more N-terminal and/or C-terminal amino acids relative to a full-length TadA (e.g., 1, 2, 3, 4, 5, 6, 7, 8, 9, 10, 11, 12, 13, 14, 15, 6, 17, 18, 19, or 20 N-terminal and/or C terminal amino acid residues may be missing relative to a full length TadA. In some embodiments, a TadA polypeptide or TadA domain does not comprise an N-terminal methionine. In some embodiments, a wild type E. coli TadA comprises the amino acid sequence of SEQ ID NO:47. In some embodiments, a mutated/evolved E. coli TadA* comprises the amino acid sequence of SEQ ID NOs:48 or 78-82. In some embodiments, a polynucleotide encoding a TadA/TadA* may be codon optimized for expression in an organism.

In some embodiments, the first deaminase domain may be linked to the second deaminase domain via a linker (e.g., a peptide linker) to form an adenine deaminase dimer. In some embodiments, the first deaminase domain may be linked to the second deaminase domain via a GS linker. In some embodiments, a GS linker may comprise the amino acid sequence SGGS (SEQ ID NO:25), (GGS)n, or S(GGS)n (one or more repeats of SEQ ID NO:26), wherein n is 1-20 (e.g., 1, 2, 3, 4, 5, 6, 7, 8, 9, 10, 11, 12, 13, 14, 15, 16, 17, 18, 19, 20, and any range or value therein). In some embodiments, a GS linker may comprise the amino acid sequence SGGSGGSGGS (SEQ ID NO:27), SGSETPGTSESATPES (SEQ ID NO:28), and/or SGGSSGGSSGSETPGTSESATPESSGGSSGGS (SEQ ID NO:29). In some embodiments, the adenine deaminase dimer comprises a first deaminase domain linked to a second deaminase domain via SGGSSGGSSGSETPGTSESATPESSGGSSGGS (SEQ ID NO:29). In some embodiments, the first deaminase domain is linked at its C-terminus end to the N-terminus of the second deaminase domain. In some embodiments, the second deaminase domain is linked at its C-terminus end to the N-terminus of the first deaminase domain.

Fusion proteins of the invention comprising a Cas12a domain linked to a polypeptide of interest as described herein may be used in combination with a guide RNA (gRNA, CRISPR array, CRISPR RNA, crRNA), designed to function with a Cas12a domain, to modify a target nucleic acid. A guide nucleic acid (CRISPR RNA, CRISPR DNA, crRNA, crDNA) useful with this invention comprises a spacer sequence and a repeat sequence. The guide nucleic acid is capable of forming a complex with the Cas12a domain of the fusion protein and the spacer sequence is capable of hybridizing to a target nucleic acid, thereby guiding the Cas12a domain and the polypeptide of interest to the target nucleic acid, wherein the target nucleic acid is modified (e.g., cleaving or editing) or modulated (e.g., modulating transcription) by the polypeptide of interest of the fusion protein. As an example, a fusion protein comprising a Cas12a domain linked to an adenine deaminase domain as described herein may be used in combination with a Cas12a guide nucleic acid to modify a target nucleic acid, wherein the adenine deaminase domain of the fusion protein deaminates an adenosine base in the target nucleic acid, thereby editing the target nucleic acid.

A "guide nucleic acid," "guide RNA," "gRNA," "CRISPR RNA/DNA" "crRNA" or "crDNA" as used herein means a nucleic acid that comprises at least one spacer sequence, which is complementary to (and hybridizes to) a target DNA (e.g., protospacer), and at least one repeat sequence (e.g., a repeat of a Type V Cas12a CRISPR-Cas system, or a fragment or portion thereof), wherein the repeat sequence is linked to the 5' end of the spacer sequence. The design of a gRNA of this invention is based on Type V Cas12a CRISPR-Cas systems. In some embodiments, a gRNA for a Cas12a may comprise, from 5' to 3', a repeat sequence (full length or portion thereof ("handle"); e.g., pseudoknot-like structure) and a spacer sequence. In some embodiments, a guide nucleic acid may comprise more than one repeat sequence-spacer sequence (e.g., 2, 3, 4, 5, 6, 7, 8, 9, 10, or more repeat-spacer sequences) (e.g., repeat-spacer-repeat; e.g., repeat-spacer-repeat-spacer-repeat-spacer-repeat-spacer-repeat-spacer, and the like). The guide nucleic acids of this invention are synthetic, human-made and not found in nature. A gRNA can be quite long and may be used as an aptamer (such as in MS2 recruitment strategy) or other RNA structures hanging off the spacer.

A "repeat sequence" as used herein, refers to, for example, any repeat sequence of a wild-type CRISPR Cas12a locus or a repeat sequence of a synthetic crRNA. A repeat sequence useful with this invention can be any known or later identified repeat sequence of a CRISPR Cas12a locus (Type V) or it can be a synthetic repeat designed to function in a Type V CRISPR-Cas system. A repeat sequence may comprise a hairpin structure and/or a stem loop structure. In some embodiments, a repeat sequence may form a pseudoknot-like structure at its 5' end (i.e., "handle"). Thus, in some embodiments, a repeat sequence can be identical to or substantially identical (e.g., at least 70% identical) to a repeat sequence from wild-type Type V CRISPR loci. A repeat sequence from a wild-type Cas12a (Type V) CRISPR locus may be determined through established algorithms, such as using the CRISPRfinder offered through CRISPRdb (see, Grissa et al. Nucleic Acids Res. 35(Web Server issue): W52-7). In some embodiments, a repeat sequence or portion thereof is linked to the 5' end of a spacer sequence, thereby forming a repeat-spacer sequence (e.g., guide RNA, crRNA).

In some embodiments, a repeat sequence comprises, consists essentially of, or consists of at least 10 nucleotides depending on the particular repeat and whether the guide RNA comprising the repeat is processed or unprocessed (e.g., about 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 to 100 or more nucleotides, or any range or value therein). In some embodiments, a repeat sequence comprises, consists essentially of, or consists of about 10 to about 20, about 10 to about 30, about 10 to about 45, about 10 to about 50, about 15 to about 30, about 15 to about 40, about 15 to about 45, about 15 to about 50, about 20 to about 30, about 20 to about 40, about 20 to about 50, about 30 to about 40, about 40 to about 80, about 50 to about 100 or more nucleotides.

A repeat sequence linked to the 5' end of a spacer sequence can comprise a portion of a repeat sequence (e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35 or more contiguous nucleotides of a wild type repeat sequence). In some embodiments, a portion of a repeat sequence linked to the 5' end of a spacer sequence can be about five to about ten consecutive nucleotides in length (e.g., about 5, 6, 7, 8, 9, 10 nucleotides) and have at least 90% identity (e.g., at least about 90%, 91%, 92%, 93%, 94%, 95%, 96%, 97%, 98%, 99%, or more) to the same region (e.g., 5' end) of a wild type Cas12a repeat nucleotide sequence. In some embodiments, a portion of a repeat sequence comprises a pseudoknot-like structure at its 5' end (e.g., "handle")

A "spacer sequence" as used herein is a nucleotide sequence that is complementary to a target nucleic acid (e.g., target DNA) (e.g, protospacer). The spacer sequence can be fully complementary or substantially complementary (e.g., at least about 70% complementary (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a target nucleic acid. Thus, in some embodiments, the spacer sequence can have one, two, three, four, or five mismatches as compared to the target nucleic acid, which mismatches can be contiguous or noncontiguous. In some embodiments, the spacer sequence can have 70% complementarity to a target nucleic acid. In other embodiments, the spacer nucleotide sequence can have 80% complementarity to a target nucleic acid. In still other embodiments, the spacer nucleotide sequence can have 85%, 90%, 95%, 96%, 97%, 98%, 99% or 99.5% complementarity, and the like, to the target nucleic acid (protospacer). In some embodiments, the spacer sequence is 100% complementary to the target nucleic acid. A spacer sequence may have a length from about 15 nucleotides to about 30 nucleotides (e.g., 15, 16, 17, 18, 19, 20, 21, 22, 23, 24, 25, 26, 27, 28, 29, or 30 nucleotides, or any range or value therein). Thus, in some embodiments, a spacer sequence may have complete complementarity or substantial complementarity over a region of a target nucleic acid (e.g., protospacer) that is at least about 15 nucleotides to about 30 nucleotides in length. In some embodiments, the spacer is about 20 nucleotides in length. In some embodiments, the spacer is about 23 nucleotides in length.

In some embodiments, the 5' region of a spacer sequence of a guide RNA may be identical to a target DNA, while the 3' region of the spacer may be substantially identical to the target DNA and therefore, the overall complementarity of the spacer sequence to the target DNA may be less than 100%. Thus, for example, the first 1, 2, 3, 4, 5, 6, 7, 8, and the like, nucleotides in the 5' region of, for example, a 20 nucleotide spacer sequence (i.e., seed region) may be 100% complementary to the target DNA, while the remaining nucleotides in the 3' region of the spacer sequence are substantially complementary (e.g., at least about 70% complementary) to the target DNA. In some embodiments, the first 1 to 8 nucleotides (e.g., the first 1, 2, 3, 4, 5, 6, 7, 8, nucleotides, and any range therein) of the 5' end of the spacer sequence may be 100% complementary to the target DNA, while the remaining nucleotides in the 3' region of the spacer sequence are substantially complementary (e.g., at least about 50% complementary (e.g., 50%, 55%, 60%, 65%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to the target DNA. In some embodiments, the seed region of a spacer may be about 5 to 6 nucleotides in length. In some embodiments, the seed region of a spacer is 5 nucleotides in length. In some embodiments, the seed region of a spacer is 6 nucleotides in length.

As used herein, a "target nucleic acid", "target DNA," "target nucleotide sequence," "target region," or a "target region in the genome" refers to a region of an organism's genome that is fully complementary (100% complementary) or substantially complementary (e.g., at least 70% complementary (e.g., 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, or more)) to a spacer sequence in a guide RNA of this invention. A target region useful for a CRISPR-Cas12a system is located immediately 3' to a PAM sequence in the genome of the organism. A target region may be selected from any at least 15 consecutive nucleotides (e.g., 16, 17, 18, 19, 20, 21, 22, 23, 24, 25, 26, 27, 28, 29, 30 nucleotides, and the like) located immediately adjacent to a PAM sequence.

A "protospacer sequence" refers to the target double stranded DNA and specifically to the portion of the target DNA (e.g., or target region in the genome) that is fully or substantially complementary (and hybridizes) to the spacer sequence of the CRISPR repeat-spacer sequences (e.g., guide RNAs, CRISPR arrays, crRNAs). In the case of Type V CRISPR-Cas Cas12a systems, the protospacer sequence is flanked (immediately adjacent to) a protospacer adjacent motif (PAM). The PAM is located at the 5' end on the non-target strand and at the 3' end of the target strand (see below, as an example).

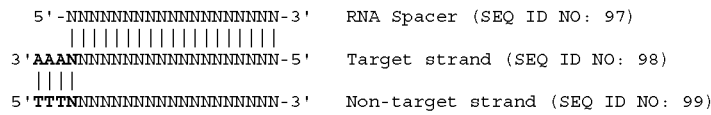

| | |
|---|---|
| 5'-NNNNNNNNNNNNNNNNNNNN-3' | RNA Spacer (SEQ ID NO: 97) |
| ‖‖‖‖‖‖‖‖‖‖‖‖‖‖‖‖‖‖‖‖ | |
| 3'AAANNNNNNNNNNNNNNNNNNNNN-5' | Target strand (SEQ ID NO: 98) |
| ‖‖‖‖ | |
| 5'TTTNNNNNNNNNNNNNNNNNNNNN-3' | Non-target strand (SEQ ID NO: 99) |

Canonical Cas12a PAMs are T rich. In some embodiments, a canonical Cas12a PAM sequence may be 5'-TTN, 5'-TTTN, or 5'-TTTV. In some embodiments, non-canonical PAMs may be used but may be less efficient.

Additional PAM sequences may be determined by those skilled in the art through established experimental and computational approaches. Thus, for example, experimental approaches include targeting a sequence flanked by all possible nucleotide sequences and identifying sequence members that do not undergo targeting, such as through the transformation of target plasmid DNA (Esvelt et al. 2013. Nat. Methods 10:1116-1121; Jiang et al. 2013. Nat. Biotechnol. 31:233-239). In some aspects, a computational approach can include performing BLAST searches of natural spacers to identify the original target DNA sequences in bacteriophages or plasmids and aligning these sequences to determine conserved sequences adjacent to the target sequence (Briner and Barrangou. 2014. Appl. Environ. Microbiol. 80:994-1001; Mojica et al. 2009. Microbiology 155:733-740).

In some embodiments, complexes and compositions are provided, which comprise one or more (e.g., 1, 2, 3, 4, 5, 6, 7, 8, or more) fusion proteins of the present invention and one or more (e.g., 1, 2, 3, 4, 5, 6, 7, 8, or more) guide nucleic acids (e.g., CRISPR RNA/DNA, e.g., crRNA/crDNA). In some embodiments, polynucleotides or nucleic acid constructs are provided that encode the polypeptides, fusion proteins, guide nucleic acids, and/or complexes of the invention. In some embodiments, nucleic acid constructs, expression cassettes and/or vectors comprising the polynucleotides of the invention and/or one or more guide nucleic acids are provided. In some embodiments, a polynucleotide encoding a fusion protein of the invention may be encoded on the same or on a separate polynucleotide, nucleic acid construct, expression cassette or vector from that comprising the guide nucleic acid. When the fusion protein is encoded on a separate polynucleotide, nucleic acid construct, expression cassette or vector from that comprising the guide nucleic acid, the polynucleotide, nucleic acid construct, expression cassette or vector encoding the fusion protein of the invention may be provided (e.g., contacted with a target nucleic acid) prior to, concurrently with, or after the guide nucleic acid is provided (e.g., contacted with the target nucleic acid).

In some embodiments, polynucleotides, nucleic acid constructs, expression cassettes and/or vectors of the invention may be codon optimized for expression in an organism. In some embodiments, an optimized polynucleotide, nucleic acid construct, or expression cassette of the invention may be about 70% to 100% identical (e.g., about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99%, 99.5% or 100%) to the polynucleotides, nucleic acid constructs or expression cassettes encoding the polypeptides, fusion proteins and complexes of the invention.

In some embodiments, a cell comprising one or more polynucleotides, guide nucleic acids, nucleic acid constructs, expression cassettes or vectors of the invention is provided.

The polypeptides, fusion proteins, guide RNAs, complexes, and compositions of the invention and polynucleotides/nucleic acid constructs/expression cassettes/vectors encoding the same may be used for modifying target nucleic acids and/or their expression.

In some embodiments, the fusion protein of the invention is an adenine base editor (ABE) for use in base editing a target nucleic acid, wherein the fusion protein comprises a Cas12a domain linked to an adenine deaminase domain.

In some embodiments, a method of modifying a target nucleic acid is provided, the method comprising contacting the target nucleic acid with: (a)(i) a fusion protein of the invention, and (a)(ii) a guide nucleic acid (e.g., CRISPR RNA, CRISPR DNA, crRNA, crDNA); (b) a complex comprising the fusion protein of the invention and a guide nucleic acid; (c) a composition comprising a fusion protein of the invention and a guide nucleic acid; and/or (d) a system of the invention, thereby modifying a target nucleic acid. A target nucleic acid may be contacted with the fusion protein prior to, concurrently with or after contacting the target nucleic acid with the guide nucleic acid.

In some embodiments, a method of modifying a target nucleic acid is provided, the method comprising contacting the target nucleic acid with a fusion protein comprising any one of the amino acid sequences of SEQ ID NOs:49-77 or 90-96 and a guide nucleic acid. A target nucleic acid may be contacted with a fusion protein of the invention prior to, concurrently with or after contacting the target nucleic acid with the guide nucleic acid.

In some embodiments, a method of modifying a target nucleic acid is provided, the method comprising contacting a cell or a cell free system comprising the target nucleic acid with: (a)(i) a polynucleotide encoding a polypeptide of the invention, or a fusion protein of the invention, or an expression cassette or vector comprising the same, and (a)(ii) a guide nucleic acid, and/or an expression cassette or vector comprising the same; and/or (b) a nucleic acid construct encoding a complex comprising a fusion protein of the invention and a guide nucleic acid, and/or an expression cassette or vector comprising the same under conditions wherein the fusion protein is expressed and forms a complex with the guide nucleic acid, the complex hybridizing to the target nucleic acid, thereby modifying the target nucleic acid. When provided on separate constructs, the target nucleic acid may be contacted with the polynucleotide, nucleic acid construct, expression cassette or vector encoding the fusion protein prior to, concurrently with or after contacting the target nucleic acid with the guide nucleic acid.

In some embodiments, a method of modifying a target nucleic acid is provided, the method comprising contacting a cell or a cell free system comprising the target nucleic acid with a polynucleotide encoding a fusion protein comprising any one of the amino acid sequences of SEQ ID NOs:49-77 or 90-96, or an expression cassette or vector comprising the same and a guide nucleic acid, or an expression cassette or vector comprising the same under conditions wherein the fusion protein is expressed and forms a complex with the guide nucleic acid, the complex hybridizing to the target nucleic acid, thereby modifying the target nucleic acid. When provided on separate constructs, the target nucleic acid may be contacted with the polynucleotide, nucleic acid construct, expression cassette or vector encoding the fusion protein prior to, concurrently with or after contacting the target nucleic acid with the guide nucleic acid.

In some embodiments, the present invention provides a method of editing a target nucleic acid, the method comprising contacting the target nucleic acid with: (a)(i) a fusion protein of the invention, and (a)(ii) a guide nucleic acid; (b) a complex comprising a fusion protein of the invention and guide nucleic acid; (c) a composition comprising (i) a fusion protein of the invention and (ii) a guide nucleic acid; and/or (d)(i) a CRISPR-Cas system of the invention, wherein the adenine deaminase domain converts an adenosine (A) to a guanine (G) in the target nucleic acid, thereby editing the target nucleic acid to produce a (point) mutation. A target nucleic acid may be contacted with a fusion protein of the invention prior to, concurrently with or after contacting the target nucleic acid with the guide nucleic acid.

In some embodiments, a method of editing a target nucleic acid is provided, the method comprising contacting the target nucleic acid with a fusion protein comprising any one of the amino acid sequences of SEQ ID NOs:49-77 or 90-96 and a guide nucleic acid, thereby editing the target nucleic acid. The target nucleic acid may be contacted with the fusion protein of the invention prior to, concurrently with or after contacting the target nucleic acid with the guide nucleic acid.

In some embodiments, a method of editing a target nucleic acid is provided, the method comprising contacting a cell or a cell free system comprising the target nucleic acid with: (a)(i) a polynucleotide encoding a fusion protein of the invention, and/or an expression cassette or vector comprising the same, and (a)(ii) a guide nucleic acid, and/or an expression cassette or vector comprising (a)(i) and/or (a)(ii); and/or (b) a nucleic acid construct encoding a complex comprising a fusion protein of the invention and a guide nucleic acid, or an or an expression cassette or vector comprising the same under conditions wherein the fusion protein is expressed and forms a complex with the guide nucleic acid, the complex hybridizing to the target nucleic acid, wherein the adenine deaminase domain converts an adenosine (A) to a guanine (G) in the target nucleic acid, thereby editing the target nucleic acid to produce a (point) mutation. When provided on separate constructs, the target nucleic acid may be contacted with the fusion protein prior to, concurrently with or after contacting the target nucleic acid with the guide nucleic acid.

In some embodiments, a method of editing a target nucleic acid is provided, the method comprising contacting a cell or a cell free system comprising the target nucleic acid with a polynucleotide encoding a fusion protein comprising any one of the amino acid sequences of SEQ ID NOs:49-77 or 90-96, or an expression cassette or vector comprising the same and a guide nucleic acid, or an expression cassette or vector comprising the same under conditions wherein the fusion protein is expressed and forms a complex with the guide nucleic acid, the complex hybridizing to the target nucleic acid, thereby editing the target nucleic acid. The polynucleotide encoding the fusion protein comprising any one of the amino acid sequences of SEQ ID NOs:49-77 or 90-96 may be present on the same expression cassette or vector that comprises the guide nucleic acid. When the polynucleotide encoding the fusion protein comprising any one of the amino acid sequences of SEQ ID NOs:49-77 or 90-96 is on a separate expression cassette or vector from that comprising the guide nucleic acid, the target nucleic acid may be contacted with the expression cassette/vector comprising the fusion protein prior to, concurrently with or after contacting the target nucleic acid with the expression cassette/vector comprising the guide nucleic acid.

In some embodiments, the adenine deaminase of a fusion protein of the invention generates an A→G conversion in the sense (e.g., "+"; template) strand of the target nucleic acid or a T→C conversion in the antisense (e.g., "−", complementary) strand of the target nucleic acid.

The fusion proteins of the invention and polypeptides and nucleic acid constructs encoding the same may be used in combination with guide nucleic acids for modifying target nucleic acid including, but not limited to, generation of A→G or T→C mutations in a target nucleic acid including, but not limited to, a plasmid sequence; generation of A→G or T→C mutations in a coding sequence to alter an amino acid identity; generation of A→G or T→C mutations in a coding sequence to generate a stop codon; generation of A→G or T→C mutations in a coding sequence to disrupt a start codon; generation of point mutations in genomic DNA to disrupt transcription factor binding; generation of point mutations in genomic DNA to disrupt splice junctions; and/or other nucleic acid modifications generated by a fusion protein comprising a Cas12a domain fused to other domains (polypeptides of interest) via any one of the amino acid sequences SEQ ID NOs:1-24 (e.g., peptide linkers).

The fusion proteins of the invention and polypeptides and nucleic acid constructs encoding the same may be useful for modifying the target nucleic acid of any organism, including but not limited to, an animal, a plant, a fungus, an archaeon, or a bacterium. An animal can include, but is not limited to, a mammal, an insect, a fish, a bird, and the like.

Exemplary mammals for which this invention may be useful include, but are not limited to, primates (human and non-human (e.g., a chimpanzee, baboon, monkey, gorilla, etc.)), cats, dogs, mice, rats, ferrets, gerbils, hamsters, cows, pigs, horses, goats, donkeys, or sheep.

The target nucleic acid of any plant or plant part may be modified using the fusion proteins of the invention and polypeptides and nucleic acid constructs encoding the same. Any plant (or groupings of plants, for example, into a genus or higher order classification) can be employed in practicing this invention including an angiosperm, a gymnosperm, a monocot, a dicot, a C3, C4, CAM plant, a bryophyte, a fern and/or fern ally, a microalgae, and/or a macroalgae. A plant and/or plant part useful with this invention may be a plant and/or plant part of any plant species/variety/cultivar. The term "plant part," as used herein, includes but is not limited to, embryos, pollen, ovules, seeds, leaves, stems, shoots, flowers, branches, fruit, kernels, ears, cobs, husks, stalks, roots, root tips, anthers, plant cells including plant cells that are intact in plants and/or parts of plants, plant protoplasts, plant tissues, plant cell tissue cultures, plant calli, plant clumps, and the like. As used herein, "shoot" refers to the above ground parts including the leaves and stems. Further, as used herein, "plant cell" refers to a structural and physiological unit of the plant, which comprises a cell wall and also may refer to a protoplast. A plant cell can be in the form of an isolated single cell or can be a cultured cell or can be a part of a higher-organized unit such as, for example, a plant tissue or a plant organ.

The fusion proteins of the invention and polypeptides and nucleic acid constructs encoding the same may be used to modify (e.g., base edit, cleave, nick etc) the target nucleic acid of any plant or plant part. Non-limiting examples of plants useful with the present invention include turf grasses (e.g., bluegrass, bentgrass, ryegrass, fescue), feather reed grass, tufted hair grass, miscanthus, arundo, switchgrass, vegetable crops, including artichokes, kohlrabi, arugula, leeks, asparagus, lettuce (e.g., head, leaf, romaine), malanga, melons (e.g., muskmelon, watermelon, crenshaw, honeydew, cantaloupe), cole crops (e.g., brussels sprouts, cabbage, cauliflower, broccoli, collards, kale, chinese cabbage, bok choy), cardoni, carrots, napa, okra, onions, celery, parsley, chick peas, parsnips, chicory, peppers, potatoes, cucurbits (e.g., marrow, cucumber, zucchini, squash, pumpkin, honeydew melon, watermelon, cantaloupe), radishes, dry bulb onions, rutabaga, eggplant, salsify, escarole, shallots, endive, garlic, spinach, green onions, squash, greens, beet (sugar beet and fodder beet), sweet potatoes, chard, horseradish, tomatoes, turnips, and spices; a fruit crop such as apples, apricots, cherries, nectarines, peaches, pears, plums, prunes, cherry, quince, fig, nuts (e.g., chestnuts, pecans, pistachios, hazelnuts, pistachios, peanuts, walnuts, macadamia nuts, almonds, and the like), citrus (e.g., clementine, kumquat, orange, grapefruit, tangerine, mandarin, lemon, lime, and the like), blueberries, black raspberries, boysenberries, cranberries, currants, gooseberries, loganberries, raspberries, strawberries, blackberries, grapes (wine and table), avocados, bananas, kiwi, persimmons, pomegranate, pineapple, tropical fruits, pomes, melon, mango, papaya, and lychee, a field crop plant such as clover, alfalfa, timothy, evening primrose, meadow foam, corn/maize (field, sweet, popcorn), hops, jojoba, buckwheat, safflower, quinoa, wheat, rice, barley, rye, millet, sorghum, oats, triticale, sorghum, tobacco, kapok, a leguminous plant (beans (e.g., green and dried), lentils, peas, soybeans), an oil plant (rape, canola, mustard, poppy, olive, sunflower, coconut, castor oil plant, cocoa bean, groundnut, oil palm), duckweed, Arabidopsis, a fiber plant (cotton, flax, hemp, jute), *Cannabis* (e.g., *Cannabis sativa, Cannabis indica,* and *Cannabis ruderalis*), lauraceae (cinnamon, camphor), or a plant such as coffee, sugar cane, tea, and natural rubber plants; and/or a bedding plant such as a flowering plant, a cactus, a succulent and/or an ornamental plant (e.g., roses, tulips, violets), as well as trees such as forest trees (broad-leaved trees and evergreens, such as conifers; e.g., elm, ash, oak, maple, fir, spruce, cedar, pine, birch, cypress, eucalyptus, willow), as well as shrubs and other nursery stock. In some embodiments, the fusion proteins of the invention and polypeptides and nucleic acid constructs encoding the same may be used to modify maize, soy, wheat, canola, rice, tomato, pepper, sunflower, raspberry, blackberry, black raspberry and/or cherry.

The present invention further comprises a kit or kits to carry out the methods of this invention. A kit of this invention can comprise reagents, buffers, and apparatus for mixing, measuring, sorting, labeling, etc., as well as instructions and the like as would be appropriate for modifying a target nucleic acid.

In some embodiments, the invention provides a kit comprising one or more polypeptides of the invention, one or more fusion proteins of the invention, one or more polynucleotides encoding one or more fusion proteins of the invention, a CRISPR-Cas system of the invention, and/or expression cassettes or vectors comprising the same, with optional instructions for the use thereof. In some embodiments, a kit may further comprise a Cas12a guide nucleic acid and/or expression cassette or vector comprising the same. In some embodiments, the guide nucleic acid may be provided on the same expression cassette or vector as a polynucleotide encoding a fusion protein of the invention.

Accordingly, in some embodiments kits are provided comprising a nucleic acid construct comprising (a) polynucleotide encoding a fusion protein as provided herein and (b) a promoter that drives expression of the polynucleotide of (a). In some embodiments, the kit may further comprise a nucleic acid construct encoding a guide nucleic acid, wherein the construct comprises a cloning site for cloning of a nucleic acid sequence identical or complementary to a target nucleic acid sequence into backbone of the guide nucleic acid.

In some embodiments, the polypeptides of the kit may further comprise one or more nuclear localization signals fused to the fusion protein, or a polynucleotide encoding the same. In some embodiments, a polynucleotide of the kit may further encode one or more selectable markers useful for identifying transformants (e.g., a nucleic acid encoding an antibiotic resistance gene, herbicide resistance gene and the like). In some embodiments, the polynucleotide may be an mRNA that may encode one or more introns within the encoded fusion protein.

The invention will now be described with reference to the following examples. It should be appreciated that these examples are not intended to limit the scope of the claims to the invention but are rather intended to be exemplary of certain embodiments. Any variations in the exemplified methods that occur to the skilled artisan are intended to fall within the scope of the invention.

EXAMPLES

Example 1

Currently, no successful version of a Cas12a-based adenine base editor has been demonstrated. Therefore, we sought to develop optimized Cas12a-based adenine base editors by designing optimal linker lengths and sequences, either N-terminal or C-terminal fusions of an adenine deaminase (e.g., the TadA/TadA* dimer) to Cas12a, based on the ideal placement of the deaminase relative to the DNA strand to be edited.

Initial fusion protein designs used Lachnospiraceae bacterium ND2006 Cas12a (LbCas12a) (e.g., SEQ ID NO:30) due to its lower temperature sensitivity and proven activity in plant cells; however, due to the high level of structural similarity between different Cas12a endonucleases, these designs should extend to Cas12a enzymes from other species (e.g., Acidaminococcus sp. Cpf1 (AsCpf1), *Francisella novicida* Cpf1 (FnCpf1) and others, see, e.g., SEQ ID NOs:31-46).

Using a structure-based approach, we have developed several linker sequences designed to enable optimal placement of an adenine deaminase domain (e.g., TadA/TadA*) relative to a Cas12a domain. These linkers allow access to the single-stranded portion of the non-target strand for base editing. Due to the placement of the termini of Cas12a and the orientation of its guide RNA, the ideal linker sequence and length likely differ significantly from the current state-of-the-art linker used in the Cas9 ABE. In this example, the linkers are designed to accommodate several possible base editor domain architectures, linking the adenine deaminase domains to either terminus of Cas12a as well as alternating the order of the wild type and evolved TadA domains. Exemplary designed linkers are provided in Table 1.

TABLE 1

Exemplary linkers

| Linker name | Length | Sequence | Energy per residue (kcal/mol) | SEQ ID NO/ Linker (L) No. |
|---|---|---|---|---|
| N1R* | 33 | NSSSTQTFDQPTPPPPDHSVPFNEQTPPPQTTT | −0.854 | 1 |
| N2R* | 31 | FDDNSQPEPDHSSLTTEPPQTTSDQPSTTDT | −0.912 | 2 |
| N3R* | 34 | NPPGPHPTPTIPTSTTTPPHTTTFEPDSLSNNTD | −0.782 | 3 |
| Nterm_4 | 36 | DGDKSDNLNPGDEEPSNGPPQPPPDDSKQLDNTPGS | −1.235 | 4 |
| N5R* | 36 | DQPQPDNWVPPQDTSETQTQDTSDNQPQEPTDTSTG | −0.850 | 5 |
| Nterm_6 | 33 | PPQEPDGSDNTQAPTERDDRPQEPQSSGHSSTE | −1.201 | 6 |
| Nterm_7 | 36 | EGGQQPPSEQKKHPDNTKAEDQSISLLPSEDGRGDE | −1.197 | 7 |

TABLE 1-continued

Exemplary linkers

| Linker name | Length | Sequence | Energy per residue (kcal/mol) | SEQ ID NO/ Linker (L) No. |
|---|---|---|---|---|
| Nterm_8 | 36 | PPSYVPKDPNRPDPSSDQRDPSPPTRELNPGNSDLP | -1.189 | 8 |
| Nterm_10 | 31 | GQEEYKPPTEEQQPPEPSSSSGGDQPLPQGD | -1.168 | 9 |
| Nterm_11 | 32 | QKHPVQQEQKDENPQEQYRDKNESSSTGGSSD | -1.121 | 10 |
| Cterm_1* | 26 | IPPNQEPPPQIPPIPPPQSPSQQQPS | -1.650 | 11 |
| Cterm_2 | 28 | YHGPPEPPPPDNREDDKTQYQQKPPDFP | -1.608 | 12 |
| Cterm_3 | 26 | IDDPPIPQPPEPRQKPEPPKYEPKNG | -1.469 | 13 |
| Cterm_4 | 25 | EQAKSSSQQTEETEIHQGKPPEQKS | -1.329 | 14 |
| Cterm_5 | 29 | DKESKDSPPSDSLKPQKDSPSRIESNNSG | -1.318 | 15 |
| Cterm_7 | 30 | FPPPPTDPNDQPQPPSDEQPGSQKDAEKDS | -1.305 | 16 |
| Cterm_8 | 30 | GQKHGSSDQKEGPPPVPPQPPIPSQPDKDR | -1.304 | 17 |
| C9R* | 31 | QNTDPTHENPPQPPDLNPQSNQQDHSDPNQD | -1.104 | 18 |
| Cterm_10 | 32 | NSWLPPEVDEEKKDEENSSKEEKERKSSSSSR | -1.286 | 19 |
| C11R* | 30 | DHPIPEPDDQTIPNSSGTGTHPQQDEPDEQ | -1.039 | 20 |
| Cterm_12 | 30 | ERDKSKSSSKDQQQQDEQQYPPPPPQKDSS | -1.256 | 21 |
| C13R* | 29 | QPQPGDNTHFQQFQTQDDTPDTTTIQLQQ | -1.019 | 22 |
| Cterm_16 | 23 | HDGNPDPPPPEPPRKEVDDPRPQ | -1.220 | 23 |
| C17R* | 28 | THPEQLFQEVIPPDGPDQVPDNSNTQPT | -1.082 | 24 |

An outline of the various constructs that were developed using the designed linkers is provided in FIGS. 1A-1C.

To test the effectiveness (including length, flexibility, and susceptibility to proteases) of each designed linker sequence, constructs were generated containing each linker sequence in a vector for expression in mammalian cells (see, for example, SEQ ID NOs:49-77 or 90-96). Each linker is tested in the relevant domain arrangement (N-terminal or C-terminal fusions of the TadA heterodimer to LbCpf1) (FIG. 1A and FIG. 1B). A subset of the C-terminal linkers (Cterm_1, Cterm_4, Cterm_5, C9R, and Cterm_10) is tested with the order of the deaminase components (mutant and wild-type) reversed (FIG. 1C). After screening in mammalian cells, the most effective linkers for each architecture are selected for testing in stable plant transformation (e.g., soybean).

Example 2. Editing in HEK293T Cells

HEK293T cells were seeded into 48-well collagen-coated plates (Corning) in the absence of antibiotic using DMEM media. At 70-80% confluency, cells were transfected with 1.5 μL of Lipofectamine 3000 (ThermoFisher Scientific) using 750 ng of base-editor plasmid and 250 ng of guide RNA plasmid according to manufacturer's protocol. After 3 days, cells were lysed, and DNA was extracted using Mag-Max DNA extraction kit (Applied Biosystems).

Spacer sequences used in the guide RNAs:

DMNT1 Spacer 1: AAGAAATATTACAACATATAAAA  SEQ ID NO: 83

DMNT1 Spacer 2: AAATCCAGAATGCACAAAGTACT  SEQ ID NO: 84

DMNT1 Spacer 3: ATATAATGCATAATAAAAACTT  SEQ ID NO: 85

RNF2 Spacer 1: TATGAGTTACAACGAACACCTCA  SEQ ID NO: 86

RNF2 Spacer 2: CACGTCTCATATGCCCCTTGGCA  SEQ ID NO: 87

RNF2 Spacer 3: GAACATGAAAACTTAAATAGAAC  SEQ ID NO: 88

RNF2 Spacer 4: ATGTTCTAAAAATGTATCCCAGT  SEQ ID NO: 89

The average observed frequency of adenine to guanine editing at edited positions within three tested spacers are provided in Table 2. All experimental linker constructs are constructed as fusions of dLbCas12a to TadA8.20m with the indicated linker from the indicated terminus (for example, the Cterm1_8.20m construct contains dLbCas12a-Cterm1-TadA8.20m). N-terminal fusions of TadA8.20m or TadA8e to dLbCas12a with a GS-XTEN-GS linker were used as controls.

TABLE 2

Average editing efficiencies - TadA 8.20m

|  | DMNT1 Spacer 1 | | DMNT1 Spacer 2 | | | DMNT1 Spacer 3 | |
| --- | --- | --- | --- | --- | --- | --- | --- |
|  | A8 | A11 | A9 | A10 | A14 | A10 | A12 |
| TadA8.20m-dLbCpf1 | 0.1% | 0.0% | 0.2% | 0.1% | 0.1% | 0.3% | 0.2% |
| TadA8e-dLbCpf1 | 0.9% | 0.4% | 2.1% | 1.1% | 1.0% | 2.0% | 1.6% |
| Cterm1_8.20nn | 0.1% | 0.0% | 0.4% | 0.1% | 0.2% | 0.2% | 0.6% |
| Cterm2_8.20m | 0.1% | 0.0% | 0.3% | 0.0% | 0.1% | 0.4% | 0.3% |
| Cterm3_8.20m | 0.1% | 0.0% | 0.2% | 0.1% | 0.2% | 0.3% | 0.1% |
| Cterm4_8.20m | 0.2% | 0.0% | 0.3% | 0.2% | 0.1% | 0.3% | 0.1% |
| Cterm5_8.20m | 0.3% | 0.0% | 0.6% | 0.2% | 0.2% | 0.2% | 0.1% |
| Cterm7_8.20m | 0.1% | 0.0% | 0.5% | 0.2% | 0.1% | 0.2% | 0.2% |
| Cterm8_8.20m | 0.2% | 0.0% | 0.3% | 0.3% | 0.3% | 0.2% | 0.2% |
| Cterm10_8.20m | 0.0% | 0.1% | 0.7% | 0.5% | 0.6% | 0.0% | 0.1% |
| Cterm12_8.20m | 0.3% | 0.1% | 0.8% | 0.4% | 0.4% | 0.2% | 0.1% |
| Cterm16_8.20m | 0.2% | 0.1% | 0.4% | 0.4% | 0.2% | 0.0% | 0.0% |
| C9R_8.20m | 0.1% | 0.0% | 0.5% | 0.3% | 0.1% | 0.2% | 0.3% |
| C11R_8.20m | 0.0% | 0.0% | 0.5% | 0.7% | 0.2% | 0.1% | 0.1% |
| C13R_8.20m | 0.0% | 0.0% | 0.4% | 0.2% | 0.0% | 0.1% | 0.1% |
| C17R_8.20m | 0.3% | 0.0% | 0.4% | 0.3% | 0.1% | 0.4% | 0.1% |
| N1R_8.20m | 0.3% | 0.1% | 0.1% | 0.1% | 0.0% | 0.4% | 0.3% |

TABLE 2-continued

Average editing efficiencies - TadA 8.20m

|  | DMNT1 Spacer 1 | | DMNT1 Spacer 2 | | | DMNT1 Spacer 3 | |
| --- | --- | --- | --- | --- | --- | --- | --- |
|  | A8 | A11 | A9 | A10 | A14 | A10 | A12 |
| N2R_8.20m | 0.3% | 0.1% | 0.2% | 0.2% | 0.1% | 0.4% | 0.1% |
| N3R_8.20m | 0.2% | 0.1% | 0.4% | 0.2% | 0.1% | 0.2% | 0.3% |
| N5R_8.20m | 0.0% | 0.0% | 0.3% | 0.2% | 0.1% | 0.5% | 0.3% |
| Nterm4_8.20m | 0.1% | 0.0% | 0.2% | 0.1% | 0.1% | 0.3% | 0.2% |
| Nterm6_8.20m | 0.1% | 0.0% | 0.2% | 0.2% | 0.1% | 0.2% | 0.1% |
| Nterm7_8.20m | 0.3% | 0.2% | 0.5% | 0.3% | 0.1% | 0.1% | 0.1% |
| Nterm8_8.20m | 0.1% | 0.0% | 0.3% | 0.2% | 0.1% | 0.1% | 0.2% |
| Nterm10_8.20m | 0.1% | 0.0% | 1.0% | 0.3% | 0.1% | 0.2% | 0.2% |
| Nterm11_8.20m | 0.4% | 0.1% | 0.3% | 0.2% | 0.2% | 0.6% | 0.3% |

Figure 3:
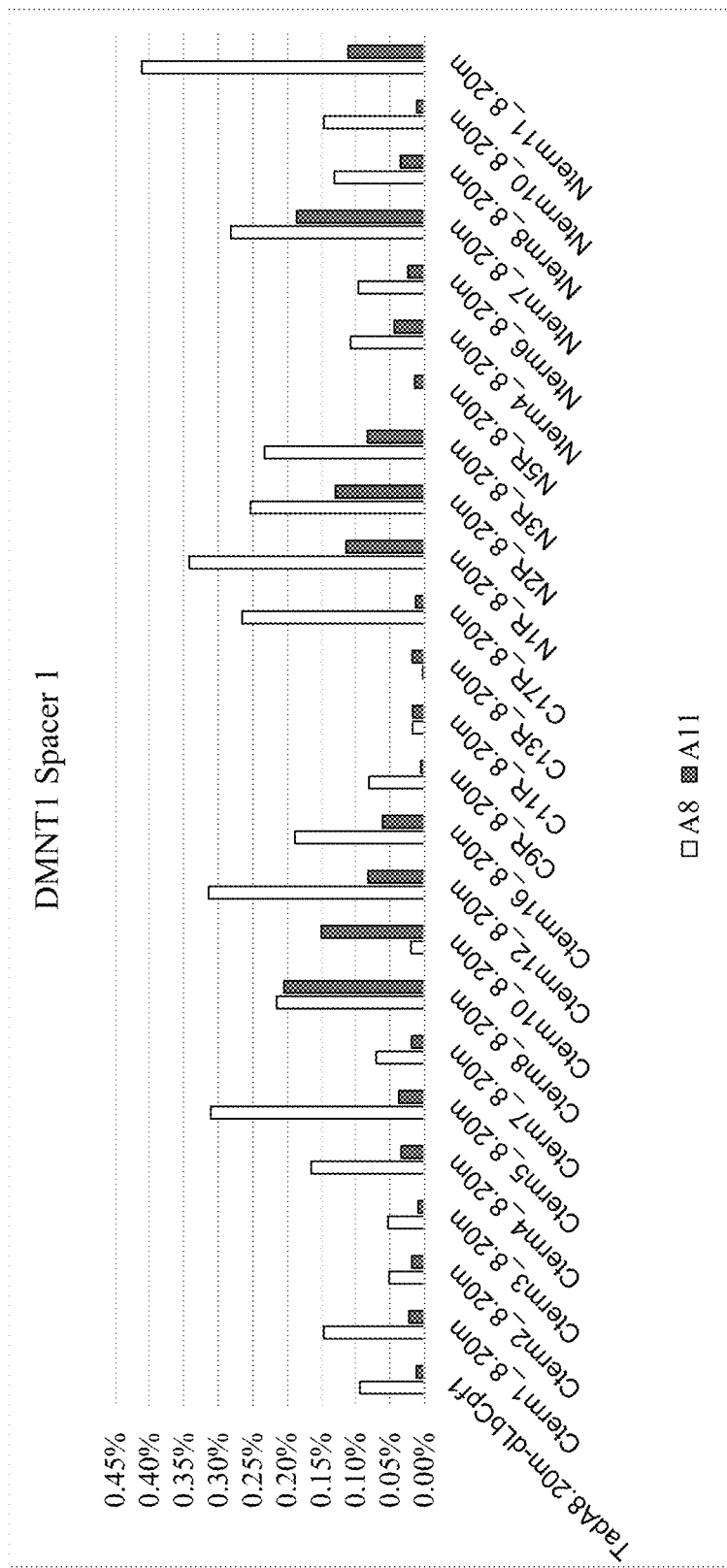
FIG. 3 is a graph of the editing frequencies of fusion proteins of the invention with DMNT1 spacer 1.
Figure 4:
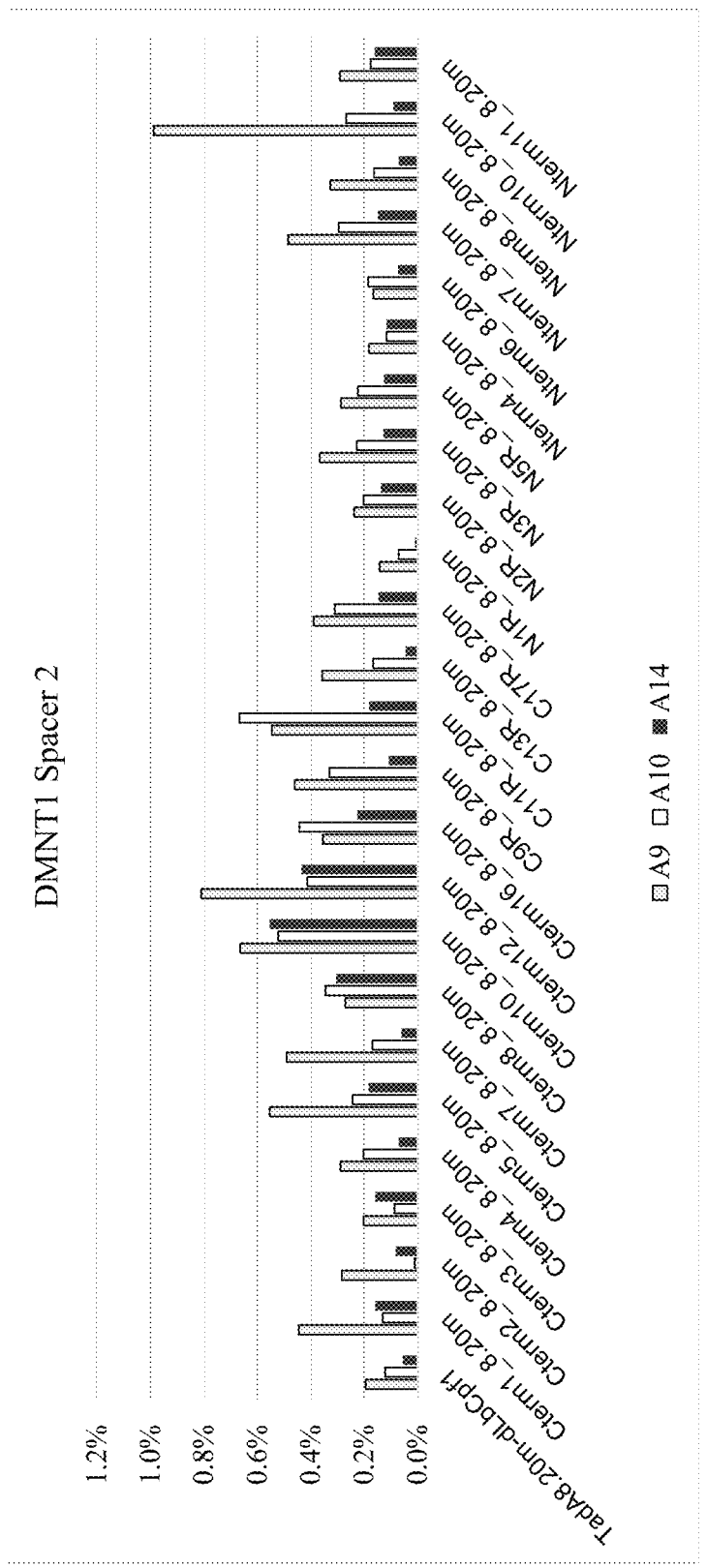
FIG. 4 is a graph of the editing frequencies of fusion proteins of the invention with DMNT1 spacer 2.
Figure 5:
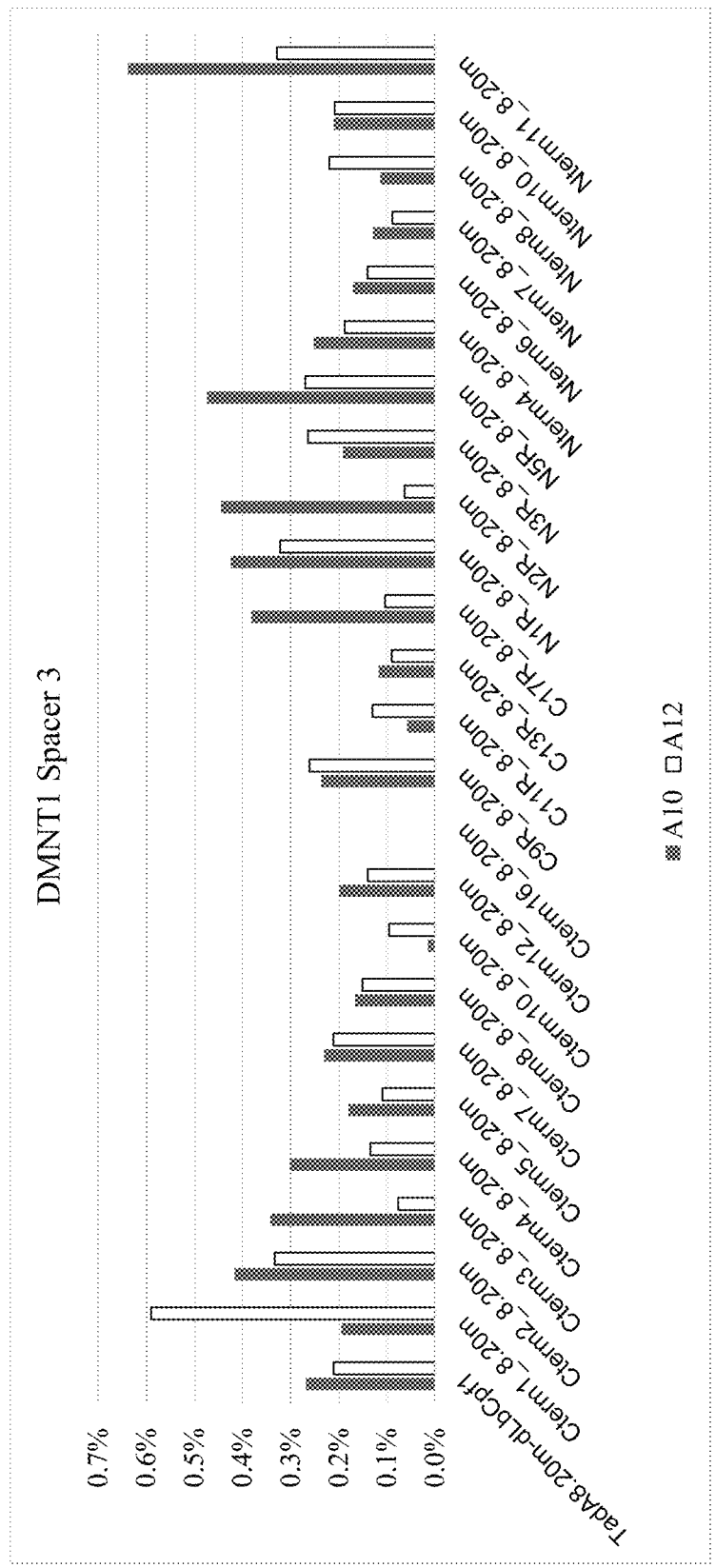
FIG. 5 is a graph of the editing frequencies of fusion proteins of the invention with DMNT1 spacer 3.

FIGS. 3-5 show the editing frequencies from Table 2 in graphical format. For each construct, the amount of adenine to guanine editing observed at each edited position within the spacer is indicated with a separate bar (e.g., A8, A11 in FIG. 3; A9, A10, A14 in FIG. 4, A10, A12 in FIG. 5 etc.). FIG. 2 shows the averaged observed activity of a LbCas12a nuclease at each of the three test spacers in the same experiment. Based on these data, five linkers were selected as candidates for further testing as fusions to the TadA8e deaminase (Cterm1_0, Cterm1_2, Nterm7, Nterm10, and Nterm11). Editing data for those constructs along with the two control ABEs are shown in Table 3 and FIGS. 6-10.

TABLE 3

Maximum level of adenine to guanine editing observed within each spacer (at any position) for each construct at each of the four tested spacers.

|  | Maximum observed editing | | | |
| --- | --- | --- | --- | --- |
| Editor | RNF2 Spacer 1 | RNF2 Spacer 2 | RNF2 Spacer 3 | RNF2 Spacer 4 |
| dLbCas12a-Cterm10-TadA8e | 2.32% | 2.35% | 2.08% | 1.15% |
| dLbCas12a-Cterm12-TadA8e | 2.43% | 2.34% | 2.24% | 3.23% |
| TadA8e-Nterm7-dLbCas12a | 2.45% | 2.23% | 1.31% | 0.88% |
| TadA8e-Nterm10-dLbCas12a | 1.76% | 2.33% | 1.35% | 0.80% |
| TadA8e-Nterm11-dLbCas12a | 1.62% | 1.95% | 1.00% | 0.75% |
| TadA8.20m-dLbCpf1 | 0.80% | 1.05% | 0.50% | 0.27% |
| TadA8e-dLbCpf1 | 2.14% | 2.17% | 1.79% | 1.05% |

Figure 6:
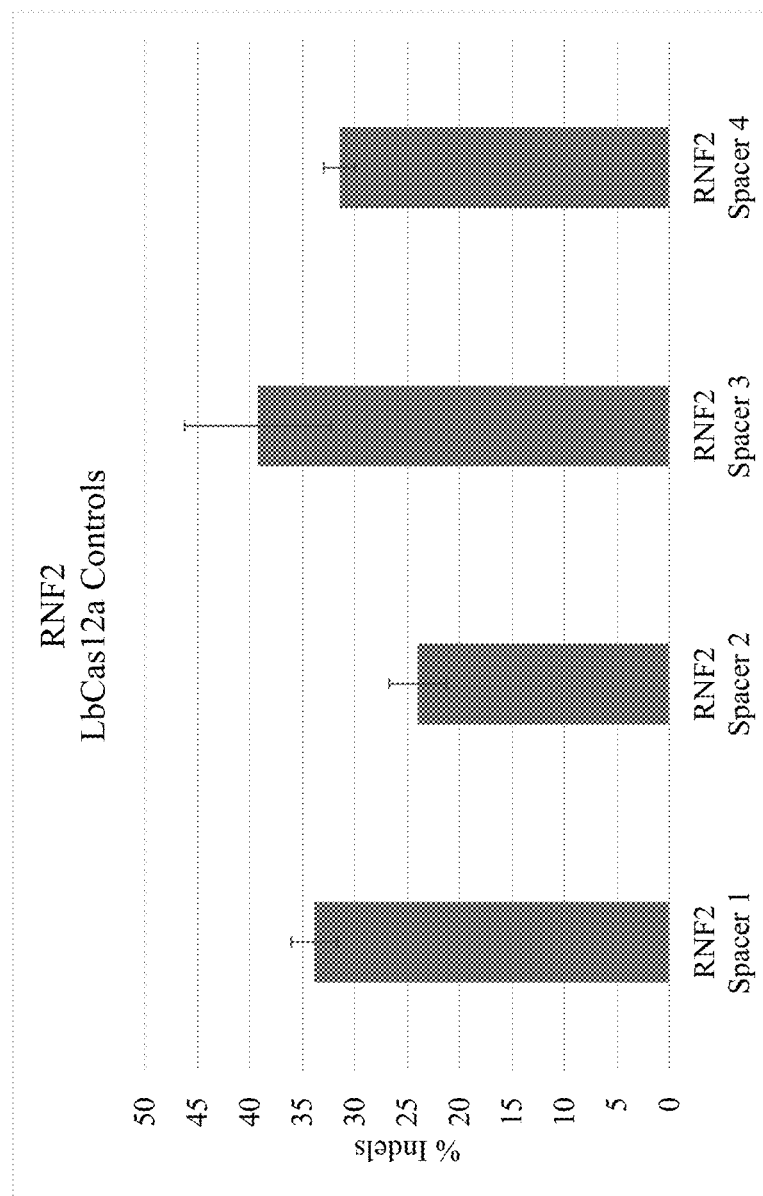
FIG. 6 shows the average observed activity of a LbCas12a nuclease at each of the four example spacers, RNF2 spacer 1, RNF2 spacer 2, RNF2 spacer 3, and RNF2 spacer 4.
Figure 7:
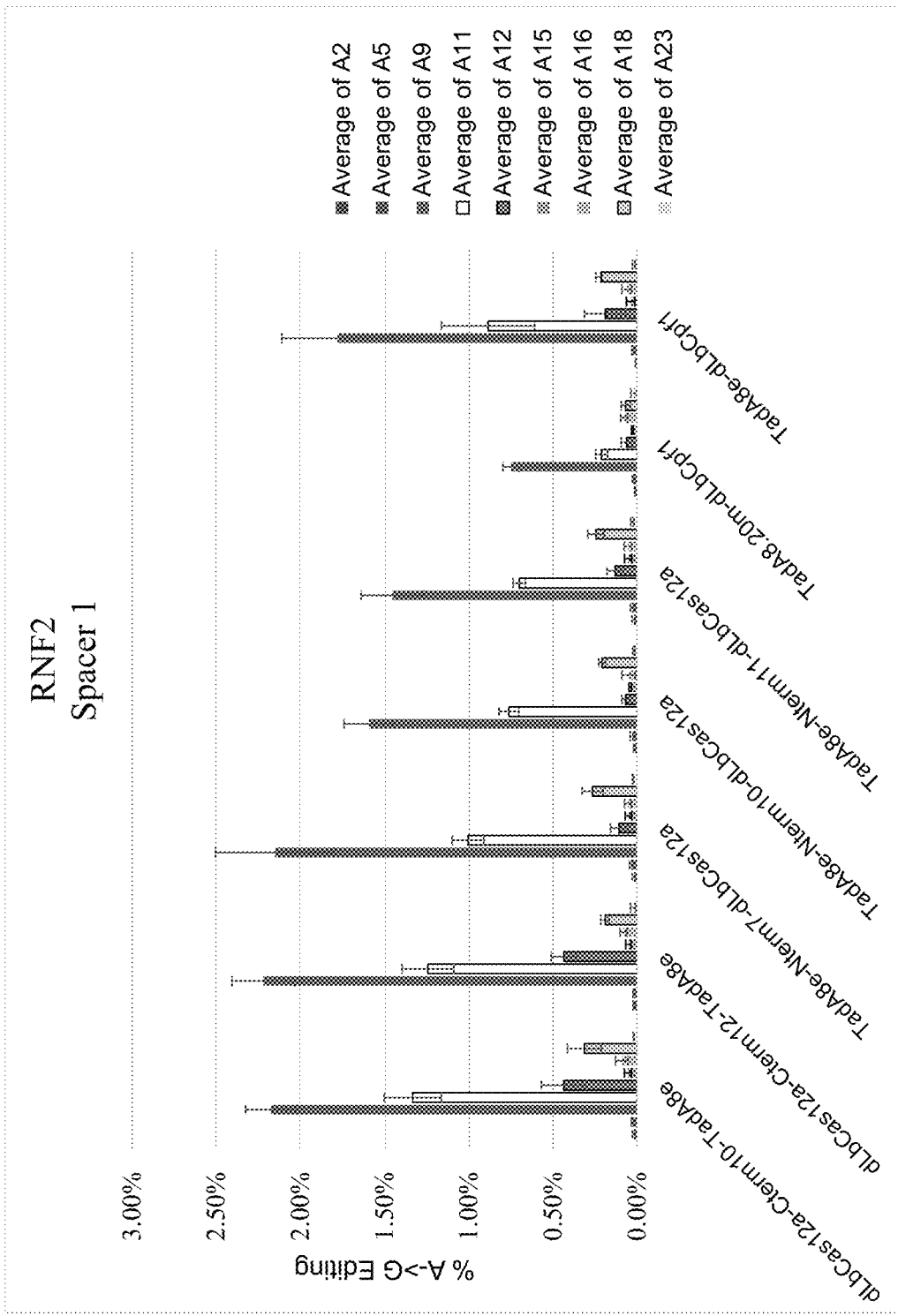
FIG. 7 is a graph of the average observed adenine to guanine editing frequencies of fusion proteins of the invention with RNF2 spacer 1.
Figure 8:
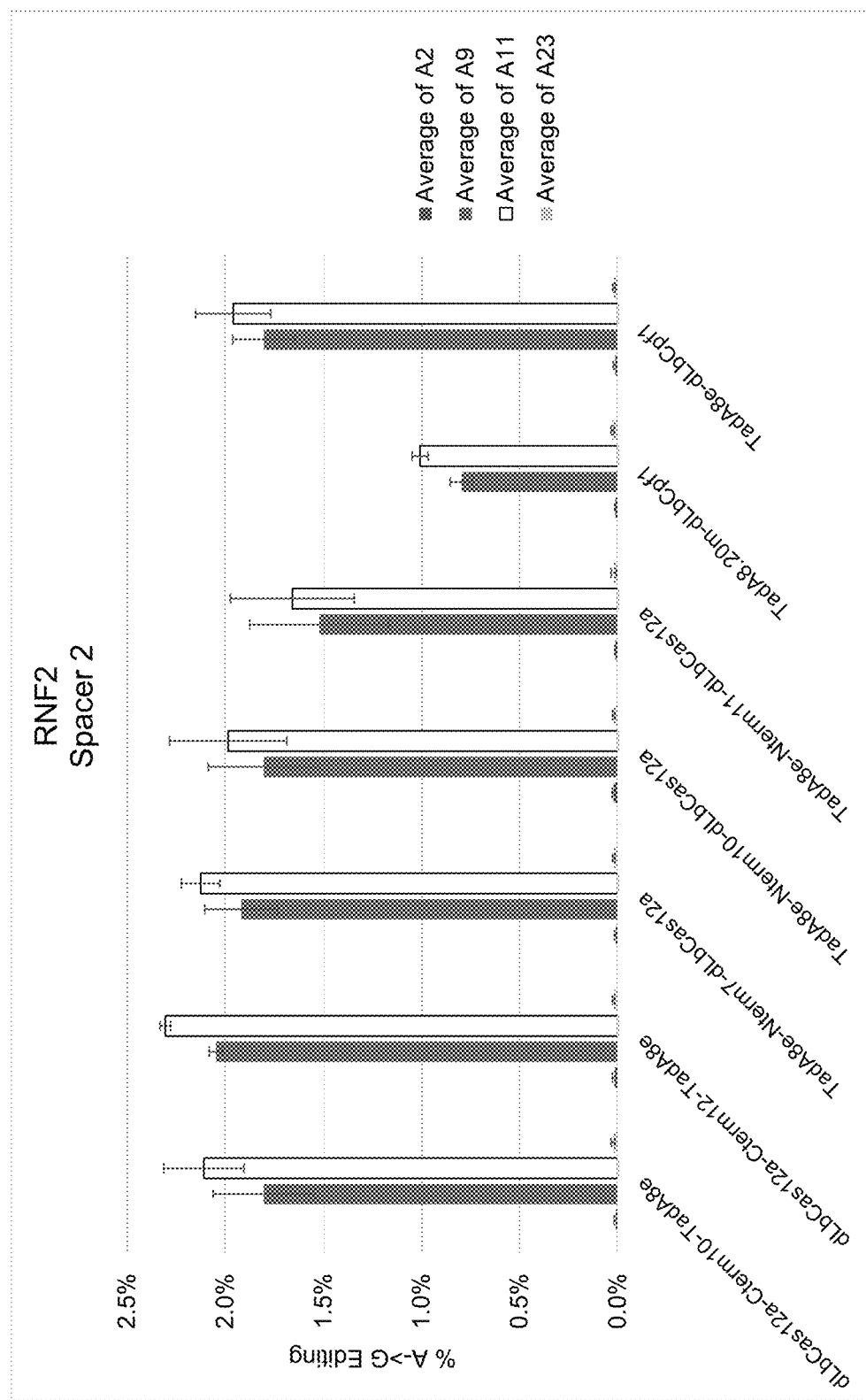
FIG. 8 is a graph of the average observed adenine to guanine editing frequencies of fusion proteins of the invention with RNF2 spacer 2.
Figure 9:
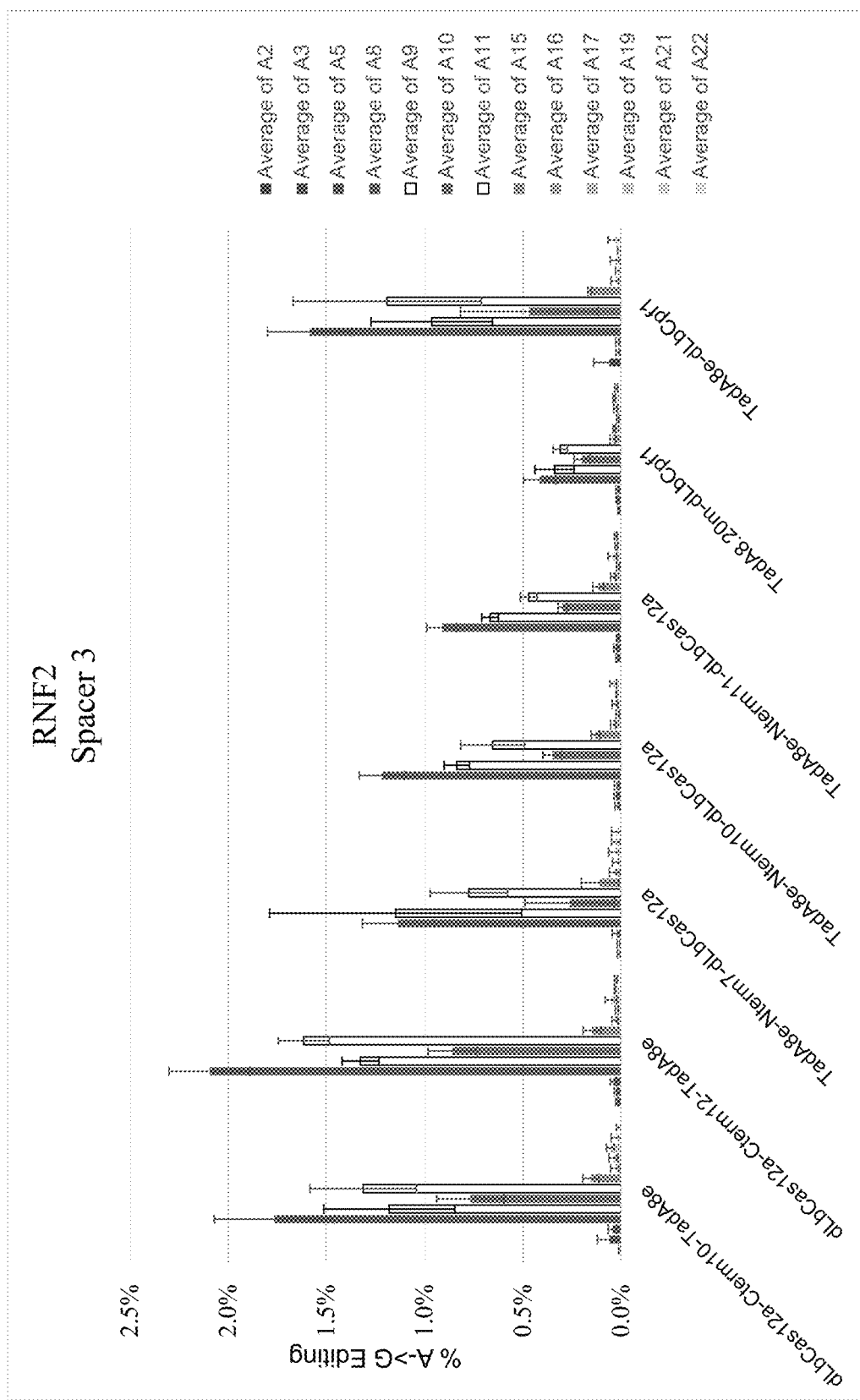
FIG. 9 is a graph of the average observed adenine to guanine editing frequencies of fusion proteins of the invention with RNF2 spacer 3.
Figure 10:
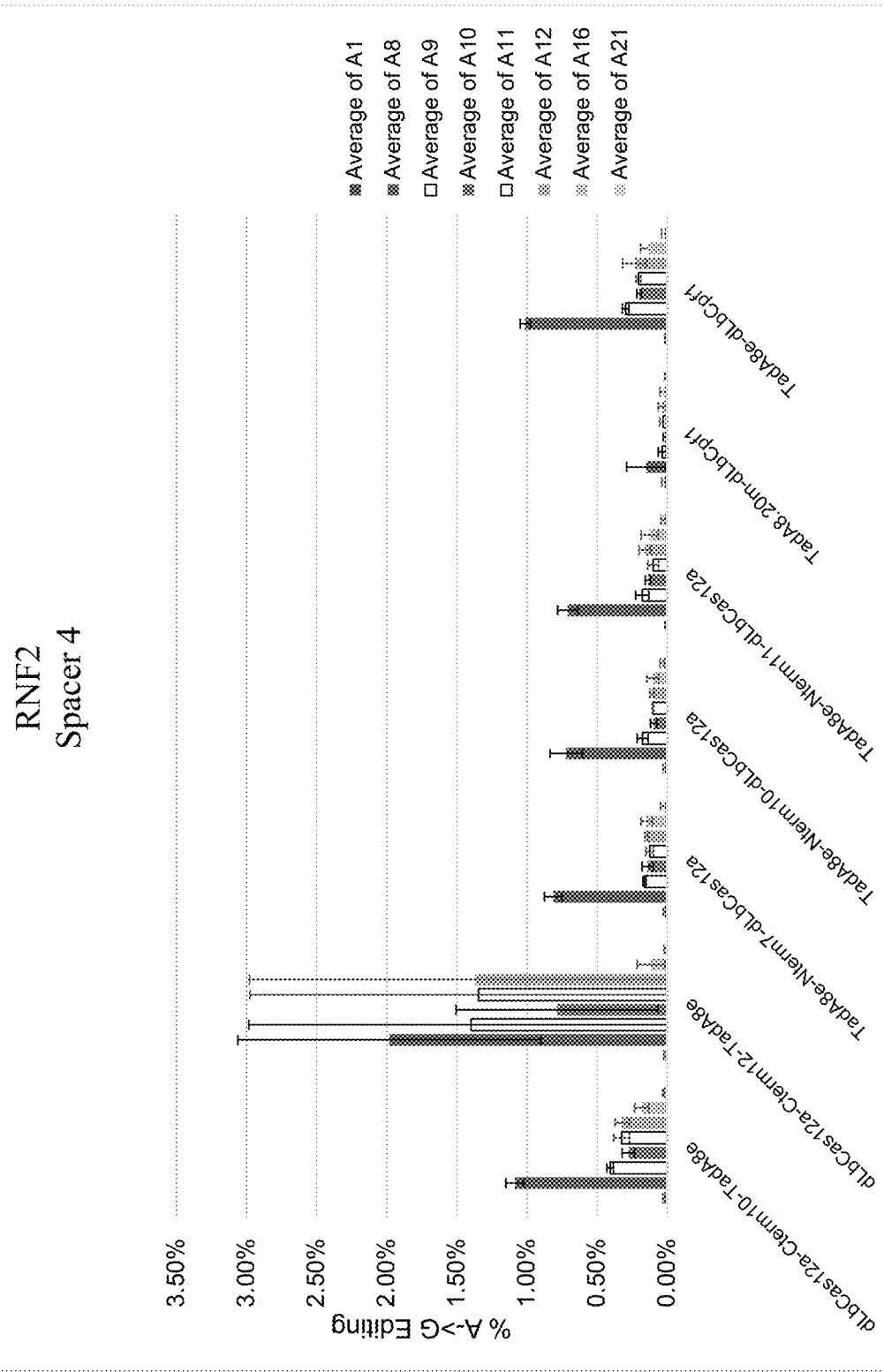
FIG. 10 is a graph of the average observed adenine to guanine editing frequencies of fusion proteins of the invention with RNF2 spacer 4.

FIGS. 7-10 show the average observed adenine to guanine editing frequencies at each position within the target spacer for the five selected linkers. FIG. 6 shows the average observed activity of a LbCas12a nuclease at each of the four test spacers in the same experiment. In each of these figures, error bars indicate the standard deviation across three replicates.

These data indicate that a C-terminal fusion of the adenine deaminase to dLbCas12 with the designed linker Cterm12 consistently outperforms control constructs.

The foregoing is illustrative of the present invention and is not to be construed as limiting thereof. The invention is defined by the following claims, with equivalents of the claims to be included therein.

SEQUENCE LISTING (99 sequences)

SEQ ID NO: 1 - protein, 33 aa, Artificial Sequence
  Synthetic peptide
NSSSTQTFDQPTPPPPDHSVPFNEQTPPPQTTT

SEQ ID NO: 2 - protein, 31 aa, Artificial Sequence
  Synthetic peptide
FDDNSQPEPDHSSLTTEPPQTTSDQPSTTDT

SEQ ID NO: 3 - protein, 34 aa, Artificial Sequence
  Synthetic peptide
NPPGPHPTPTIPTSTTTPPHTTTFEPDSLSNNTD

SEQ ID NO: 4 - protein, 36 aa, Artificial Sequence
  Synthetic peptide
DGDKSDNLNPGDEEPSNGPPQPPPDDSKQLDNTPGS

SEQ ID NO: 5 - protein, 36 aa, Artificial Sequence
  Synthetic peptide
DQPQPDNWVPPQDTSETQTQDTSDNQPQEPTDTSTG

SEQ ID NO: 6 - protein, 33 aa, Artificial Sequence
  Synthetic peptide
PPQEPDGSDNTQAPTERDDRPQEPQSSGHSSTE

SEQ ID NO: 7 - protein, 36 aa, Artificial Sequence
  Synthetic peptide
EGGQQPPSEQKKHPDNTKAEDQSISLLPSEDGRGDE

SEQ ID NO: 8 - protein, 36 aa, Artificial Sequence
  Synthetic peptide
PPSYVPKDPNRPDPSSDQRDPSPPTRELNPGNSDLP

SEQ ID NO: 9 - protein, 31 aa, Artificial Sequence
  Synthetic peptide
GQEEYKPPTEEQQPPEPSSSSGGDQPLPQGD

SEQ ID NO: 10 - protein, 32 aa, Artificial Sequence
  Synthetic peptide
QKHPVQQEQKDENPQEQYRDKNESSSTGGSSD

SEQ ID NO: 11 - protein, 26 aa, Artificial Sequence
  Synthetic peptide
IPPNQEPPPQIPPIPPPQSPSQQQPS

SEQ ID NO: 12 - protein, 28 aa, Artificial Sequence
  Synthetic peptide
YHGPPEPPPPDNREDDKTQYQQKPPDFP

SEQ ID NO: 13 - protein, 26 aa, Artificial Sequence
  Synthetic peptide
IDDPPIPQPPEPRQKPEPPKYEPKNG

SEQ ID NO: 14 - protein, 25 aa, Artificial Sequence
  Synthetic peptide
EQAKSSSQQTEETEIHQGKPPEQKS

SEQ ID NO: 15 - protein, 29 aa, Artificial Sequence
  Synthetic peptide
DKESKDSPPSDSLKPQKDSPSRIESNNSG

SEQ ID NO: 16 - protein, 30 aa, Artificial Sequence
  Synthetic peptide
FPPPPTDPNDQPQPPSDEQPGSQKDAEKDS

SEQ ID NO: 17 - protein, 30 aa, Artificial Sequence
  Synthetic peptide
GQKHGSSDQKEGPPPVPPQPPIPSQPDKDR

SEQ ID NO: 18 - protein, 31 aa, Artificial Sequence
  Synthetic peptide
QNTDPTHENPPQPPDLNPQSNQQDHSDPNQD

SEQ ID NO: 19 - protein, 32 aa, Artificial Sequence
  Synthetic peptide
NSWLPPEVDEEKKDEENSSKEEKERKSSSSSR

SEQ ID NO: 20 - protein, 30 aa, Artificial Sequence
  Synthetic peptide
DHPIPEPDDQTIPNSSGTGTHPQQDEPDEQ

SEQ ID NO: 21 - protein, 30 aa, Artificial Sequence
  Synthetic peptide
ERDKSKSSSKDQQQQDEQQYPPPPPQKDSS

SEQ ID NO: 22 - protein, 29 aa, Artificial Sequence
  Synthetic peptide
QPQPGDNTHFQQFQTQDDTPDTTTIQLQQ

SEQ ID NO: 23 - protein, 23 aa, Artificial Sequence
  Synthetic peptide
HDGNPDPPPPEPPRKEVDDPRPQ

SEQ ID NO: 24 - protein, 28 aa, Artificial Sequence
  Synthetic peptide
THPEQLFQEVIPPDGPDQVPDNSNTQPT

SEQ ID NO: 25 - protein, 61 aa, Artificial sequence
  Synthetic peptide
  MISC_FEATURE (5)..(6): Xaa may be present or absent and when present denotes Gly
  MISC_FEATURE (7)..(7): Xaa may be present or absent and when present denotes Ser
  MISC_FEATURE (8)..(9): Xaa may be present or absent and when present denotes Gly
  MISC_FEATURE (10)..(10): Xaa may be present or absent and when present denotes Ser
  MISC_FEATURE (11)..(12): Xaa may be present or absent and when present denotes Gly
  MISC_FEATURE (13)..(13): Xaa may be present or absent and when present denotes Ser
  MISC_FEATURE (14)..(15): Xaa may be present or absent and when present denotes Gly
  MISC_FEATURE (16)..(16): Xaa may be present or absent and when present denotes Ser
  MISC_FEATURE (17)..(18): Xaa may be present or absent and when present denotes Gly
  MISC_FEATURE (19)..(19): Xaa may be present or absent and when present denotes Ser
  MISC_FEATURE (20)..(21): Xaa may be present or absent and when present denotes Gly
  MISC_FEATURE (22)..(22): Xaa may be present or absent and when present denotes Ser
  MISC_FEATURE (23)..(24): Xaa may be present or absent and when present denotes Gly
  MISC_FEATURE (25)..(25): Xaa may be present or absent and when present denotes Ser
  MISC_FEATURE (26)..(27): Xaa may be present or absent and when present denotes Gly
  MISC_FEATURE (28)..(28): Xaa may be present or absent and when present denotes Ser
  MISC_FEATURE (29)..(30): Xaa may be present or absent and when present denotes Gly
  MISC_FEATURE (31)..(31): Xaa may be present or absent and when present denotes Ser
  MISC_FEATURE (32)..(33): Xaa may be present or absent and when present denotes Gly
  MISC_FEATURE (34)..(34): Xaa may be present or absent and when present denotes Ser
  MISC_FEATURE (35)..(36): Xaa may be present or absent and when present denotes Gly
  MISC_FEATURE (37)..(37): Xaa may be present or absent and when present denotes Ser
  MISC_FEATURE (38)..(39): Xaa may be present or absent and when present denotes Gly
  MISC_FEATURE (40)..(40): Xaa may be present or absent and when present denotes Ser
  MISC_FEATURE (41)..(42): Xaa may be present or absent and when present denotes Gly
  MISC_FEATURE (43)..(43): Xaa may be present or absent and when present denotes Ser
  MISC_FEATURE (44)..(45): Xaa may be present or absent and when present denotes Gly
  MISC_FEATURE (46)..(46): Xaa may be present or absent and when present denotes Ser
  MISC_FEATURE (47)..(48): Xaa may be present or absent and when present denotes Gly
  MISC_FEATURE (49)..(49): Xaa may be present or absent and when present denotes Ser
  MISC_FEATURE (50)..(51): Xaa may be present or absent and when present denotes Gly
  MISC_FEATURE (52)..(52): Xaa may be present or absent and when present denotes Ser
  MISC_FEATURE (53)..(54): Xaa may be present or absent and when present denotes Gly
  MISC_FEATURE (55)..(55): Xaa may be present or absent and when present denotes Ser
  MISC_FEATURE (56)..(57): Xaa may be present or absent and when present denotes Gly
  MISC_FEATURE (58)..(58): Xaa may be present or absent and when present denotes Ser
  MISC_FEATURE (59)..(60): Xaa may be present or absent and when present denotes Gly
  MISC_FEATURE (61)..(61): Xaa may be present or absent and when present denotes Ser
SGGSXXXXXXXXXXXXXXXXXXXXXXXXXXXXXXXXXXXXXXXXXXXXXXXXXXXXXXXXX

SEQ ID NO: 26 - protein, 4 aa, Artificial Sequence
  Synthetic peptide
SGGS

SEQ ID NO: 27 - protein, 10 aa, Artificial Sequence
  Synthetic peptide
SGGSGGSGGS

SEQ ID NO: 28 - protein, 16 aa, Artificial Sequence
  Synthetic peptide
SGSETPGTSESATPES

SEQ ID NO: 29 - protein, 32 aa, Artificial Sequence
  Synthetic peptide
SGGSSGGSSGSETPGTSESATPESSGGSSGGS

SEQ ID NO: 30 - protein, 1227 aa, Unknown
  Lachnospiraceae bacterium
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 31 - protein, 1307 aa, Acidaminococcus sp.
MTQFEGFTNLYQVSKTLRFELIPQGKTLKHIQEQGFIEEDKARNDHYKELKPIIDRIYKTYADQCLQLVQLDWENLSAAIDSYRKEKTEETRNALIEEQATYRNAIHDYFIGRTDNLTDAINKRHAEIYKGLFKAELFNGKVLKQLGTVTTTEHENALLRSFDKFTTYFSGFYENRKNVFSAEDISTAIPHRIVQDNFPKFKENCHIFTRLITAVPSLREHFENVKKAIGIFVSTSIEEVFSFPFYNQLLTQTQIDLYNQLLGGISREAGTEKIKGLNEVLNLAIQKNDETAHIIASLPHRFIPLFKQILSDRNTLSFILEEFKSDEEVIQSFCKYKTLLRNENVLETAEALFNELNSIDLTHIFISHKKLETISSALCDHWDTLRNALYERRISELTGKITKSAKEKVQRSLKHEDINLQEIISAAGKELSEAFKQKTSEILSHAHAALDQPLPTTLKKQEEKEILKSQLDSLLGLYHLLDWFAVDESNEVDPEFSARLTGIKLEMEPSLSFYNKARNYATKKPYSVEKFKLNFQMPTLASGWDVNKEKNNGAILFVKNGLYYLGIMPKQKGRYKALSFEPTEKTSEGFDKMYYDYFPDAAKMIPKCSTQLKAVTAHFQTHTTPILLSNNFIEPLEITKEIYDLNNPEKEPKKFQTAYAKKTGDQKGYREALCKWIDFTRDFLSKYTKTTSIDLSSLRPSSQYKDLGEYYAELNPLLYHISFQRIAEKEIMDAVETGKLYLFQIYNKDFAKGHHGKPNLHTLYWTGLFSPENLAKTSIKLNGQAELFYRPKSRMKRMAHRLGEKMLNKKLKDQKTPIPDTLYQELYDYVNHRLSHDLSDEARALLPNVITKEVSHEIIKDRRFTSDKFFFHVPITLNYQAANSPSKFNQRVNAYLKEHPETPIIGIDRGERNLIYITVIDSTGKILEQRSLNTIQQFDYQKKLDNREKERVAARQAWSVVGTIKDLKQGYLSQVIHEIVDLMIHYQAVVVLENLNFGFKSKRTGIAEKAVYQQFEKMLIDKLNCLVLKDYPAEKVGGVLNPYQLTDQFTSFAKMGTQSGFLFYVPAPYTSKIDPLTGFVDPFVWKTIKNHESRKHFLEGFDFLHYDVKTGDFILHFKMNRNLSFQRGLPGFMPAWDIVFEKNETQFDAKGTPFIAGKRIVPVIENHRFTGRYRDLYPANELIALLEEKGIVFRDGSNILPKLLENDDSHAIDTMVALIRSVLQMRNSNAATGEDYINSPVRDLNGVCFDSRFQNPEWPMDADANGAYHIALKGQLLLNHLKESKDLKLQNGISNQDWLAYIQELRN

SEQ ID NO: 32 - protein, 1241 aa, Butyrivibrio proteoclasticus
MLLYENYTKRNQITKSLRLELRPQGKTLRNIKELNLLEQDKAIYALLERLKPVIDEGIKDIARDTLKNCELSFEKLYEHFLSGDKKAYAKESERLKKEIVKTLIKNLPEGIGKISEINSAKYLNGVLYDFIDKTHKDSEEKQNILSDILETKGYLALFSKFLTSRITTLEQSMPKRVIENFEIYAANIPKMQDALERGAVSFAIEYESICSVDYYNQILSQEDIDSYNRLISGIMDEDGAKEKGINQTISEKNIKIKSEHLEEKPFRILKQLHKQILEEREKAFTIDHIDSDEEVVQVTKEAFEQTKEQWENIKKINGFYAKDPGDITLFIVVGPNQTHVLSQLIYGEHDRIRLLLEEYEKNTLEVLPRRTKSEDARYDKFVNAVPKKVAKESHTFDGLQKMTGDDRLFILYRDELARNYMRIKEAYGTFERDILKSRRGIKGNRDVQESLVSFYDELTKFRSALRIINSGNDEKADPIFYNTFDGIFEKANRTYKAENLCRNYVTKSPADDARIMASCLGTPARLRTHWWNGEENFAINDVAMIRRGDEYYYFVLTPDVKPVDLKTKDETDAQIFVQRKGAKSFLGLPKALFKCILEPYFESPEHKNDKNCVIEEYVSKPLTIDRRAYDIFKNGTFKKTNIGIDGLTEEKFKDDCRYLIDVYKEFIAVYTRYSCFNMSGLKRADEYNDIGEFFSDVDTRLCTMEWIPVSFERINDMVDKKEGLLFLVRSMFLYNRPRKPYERTFIQLFSDSNMEHTSMLLNSRAMIQYRAASLPRRVTHKKGSILVALRDSNGEHIPMHIREAIYKMKNNFDISSEDFIMAKAYLAEHDVAIKKANEDIIRNRRYTEDKFFLSLSYTKNADISARTLDYINDKVEEDTQDSRMAVIVTRNLKDLTYVAVVDEKNNVLEEKSLNEIDGVNYRELLKERTKIKYHDKTRLWQYDVSSKGLKEAYVELAVTQISKLATKYNAVVVVESMSSTFKDKFSFLDEQIFKAFEARLCARMSDLSFNTIKEGEAGSISNPIQVSNNNGNSYQDGVIYFLNNAYTRTLCPDTGFVDVFDKTRLITMQSKRQFFAKMKDIRIDDGEMLFTFNLEEYPTKRLLDRKEWTVKIAGDGSYFDKDKGEYVYVNDIVREQIIPALLEDKAVFDGNMAEKFLDKTAISGKSVELIYKWFANALYGIITKKDGEKIYRSPITGTEIDVSKNTTYNFGKKFMFKQEYRGDGDFLDAFLNYMQAQDIAV

SEQ ID NO: 33 - protein, 1238 aa, Candidatus methanoplasma termitum
MNNYDEFTKLYPIQKTIRFELKPQGRTMEHLETFNFFEEDRDRAEKYKILKEAIDEYHKKFIDEHLTNMSLDWNSLKQISEKYYKSREEKDKKVFLSEQKRMRQEIVSEFKKDDRFKDLFSKKLFSELLKEEIYKKGNHQEIDALKSFDKFSGYFIGLHENRKNMYSDGDEITAISNRIVNENFPKFLDNLQKYQEARKKYPEWIIKAESALVAHNIKMDIVFSLEYFNKVLNQEGIQRYNLALGGYVTKSGEKMMGLNDALNLAHQSEKSSKGRIHMTPLFKQILSEKESFSYIPDVFTEDSQLLPSIGGFFAQIENDKDGNIFDRALELISSYAEYDTERIYIRQADINRVSNVIFGEWGTLGGLMREYKADSINDINLERTCKKVDKWLDSKEFALSDVLEAIDRTGNNDAFNEYISKMRTAREKIDAARKEMKFISEKISGDEESIHIIKTLLDSVQQFLHFFNLFKARQDIPLDGAFYAEFDEVHSKLFAIVPLYNKVRNYLTKNNLNTKKIKLNFKNPTLANGWDQNKVYDYASLIFLRDGNYYLGIINPKRKKNIKFEQGSGNGPFYRKMVYKQIPGPNKNLRPVFLTSTKGKKEYKPSKEIIEGYEADKHIRGDKFDLDFCHKLIDFFKESIEKHKDWSKFNFYFSPTESYGDISEFYLDVEKQGYRMHFENISAETIDEYVEKGDLFLFQIYNKDFVKAATGKKDMHTIYWNAAFSPENLQDVVVKLNGEAELFYRDKSDIKEIVHREGEILVNRTYNGRTPVPDKIHKKLTDYHNGRTKDLGEAKEYLDKVRYFKAHYDITKDRRYLNDKIYFHVPLTLNFKANGKKNLNKMVIEKFLSDEKAHIIGIDRGERNLLYYSIIDRSGKIIDQQSLNVIDGFDYREKLNQREIEMKDARQSWNAIGKIKDLKEGYLSKAVHEITKMAIQYNAIVVMEELNYGFKRGRFKVEKQIYQKFENMLIDKMNYLVFKDAPDESPGGVLNAYQLTNPLESFAKLGKQTGILFYVPAAYTSKIDPTTGFVNLFNTSSKTNAQERKEFLQKFESISYSAKDGGIFAFAFDYRKFGTSKTDHKNVWTAYTNGERMRYIKEKKRNELFDPSKEIKEALTSSGIKYDGGQNILPDILRSNNNGLIYTMYSSFIAAIQMRVYDGKEDYIISPIKNSKGEFFRTDPKRRELPIDADANGAYNIALRGELTMRAIAEKFDPDSEKMAKLELKHKDWFEFMQTRGD

SEQ ID NO: 34 - protein, 1281 aa, Eubacterium eligens
MNGNRSIVYREFVGVIPVAKTLRNELRPVGHTQEHIIQNGLIQEDELRQEKSTELKNIMDDYYREYIDKSLSGVTDLDFTLLFELMNLVQSSPSKDNKKALEKEQSKMREQICTHLQSDSNYKNIFNAKLLKEILPDFIKNYNQYDVKDKAGKLETLALFNGFSTYFTDFFEKRKNVFTKEAVSTSIAYRIVHENSLIFLANMTSYKKISEKALDEIEVIEKNNQDKMGDWELNQIFNPDFYNMVLIQSGIDFYNEICGVVNAHMNLYCQQTKNNYNLFKMRKLHKQILAYTSTSFEVPKMFEDDMSVYNAVNAFIDETEKGNIIGKLKDIVNKYDELDEKRIYISKDFYETLSCFMSGNWNLITGCVENFYDENIHAKGKSKEEKVKKAVKEDKYKSINDVNDLVEKYIDEKERNEFKNSNAKQYIREISNIITDTETAHLEYDDHISLIESEEKADEMKKRLDMYMNMYHWAKAFIVDEVLDRDEMFYSDIDDIYNILENIVPLYNRVRNYVTQKPYNSKKIKLNFQSPTLANGWSQSKEFDNNAIILIRDNKYYLAIFNAKNKPDKKIIQGNSDKKNDNDYKKMVYNLLPGANKMLPKVFLSKKGIETFKPSDYIISGYNAHKHIKTSENFDISFCRDLIDYFKNSIEKHAEWRKYEFKFSATDSYSDISEFYREVEMQGYRIDWTYISEADINKLDEEGKIYLFQIYNKDFAENSTGKENLHTMYFKNIFSEENLDKIIKLNGQAELFYRRASVKNPVKHKKDSVLVNKTYKNQLDNGDVVRIPIPDDIYNEIYKMYNGYIKESDLSEAAKEYLDKVEVRTAQKDIVKDYRYTVDKYFIHTPITINYKVTARNNVNDMVVKYIAQNDDIHVIGIDRGERNLIYISVIDSHGNIVKQKSYNILNNYDYKKKLVEKEKTREYARKNWKSIGNIKELKEGYISGVVHEIAMLIVEYNAIIAMEDLNYGFKRGRFKVERQVYQKFESMLINKLNYFASKEKSVDEPGGLLKGYQLTYVPDNIKNLGKQCGVIFYVPAAFTSKIDPSTGFISAFNFKSISTNASRKQFFMQFDEIRYCAEKDMFSFGFDYNNFDTYNITMGKTQWTVYTNGERLQSEFNNARRTGKTKSINLTETIKLLLEDNEINYADGHDIRIDMEKMDEDKKSEFFAQLLSLYKLTVQMRNSYTEAEEQENGISYDKIISPVINDEGEFFDSDNYKESDDKECKMPKDADANGAYCIALKGLYEVLKIKSEWTEDGFDRNCLKLPHAEWLDFIQNKRYE

SEQ ID NO: 35 - protein, 1300 aa, Francisella novicida
MSIYQEFVNKYSLSKTLRFELIPQGKTLENIKARGLILDDEKRAKDYKKAKQIIDKYHQFFIEEILSSVCISEDLLQNYSDVYFKLKKSDDDNLQKDFKSAKDTIKKQISEYIKDSEKFKNLFNQNLIDAKKGQESDLILWLKQSKDNGIELFKANSDITDIDEALEIIKSFKGWTTYFKGFHENRKVNYSSNDIPTSIIYRIVDDNLPKFLENKAKYESLKDKAPEAINYEQIKKDLAEELTFDIDYKTSEVNQRVFSLDEVFEIANFNNYLNQSGITKFNTIIGGKFVNGENTKRKGINEYINLYSQQINDKTLKKYKMSVLFKQILSDTESKSFVIDKLEDDSDVVTTMQSFYEQIAAFKTVEEKSIKETLSLLFDDLKAQKLDLSKIYFKNDKSLTDLSQQVFDDYSVIGTAVLEYITQQIAPKNLDNPSKKEQELIAKKTEKAKYLSLETIKLALEEFNKHRDIDKQCRFEEILANFAAIPMIFDEIAQNKDNLAQISIKYQNQGKKDLLQASAEDDVKAIKDLLDQTNNLLHKLKIFHISQSEDKANILDKDEHFYLVFEECYFELANIVPLYNKIRNYITQKPYSDEKFKLNFENSTLANGWDKNKEPDNTAILFIKDDKYYLGVMNKKNNKIFDDKAIKENKGEGYKKIVYKLLPGANKMLPKVFFSAKSIKFYNPSEDILRIRNHSTHTKNGSPQKGYEKFEFNIEDCRKFIDFYKQSISKHPEWKDFGFRFSDTQRYNSIDEFYREVENQGYKLTFENISESYIDSVVNQGKLYLFQIYNKDFSAYSKGRPNLHTLYWKALFDERNLQDVVYKLNGEAELFYRKQSIPKKITHPAKEAIANKNKDNPKKESVFEYDLIKDKRFTEDKFFFHCPITINFKSSGANKFNDEINLLLKEKANDVHILSIDRGERHLAYYTLVDGKGNIIKQDTFNIIGNDRMKTNYHDKLAAIEKDRDSARKDWKKINNIKEMKEGYLSQVVHEIAKLVIEYNAIVVFEDLNFGFKRGRFKVEKQVYQKLEKMLIEKLNYLVFKDNEFDKTGGVLRAYQLTAPFETFKKMGKQTGIIYYVPAGFTSKICPVTGFVNQLYPKYESVSKSQEFFSKFDKICYNLDKGYFEFSFDYKNFGDKAAKGKWTIASFGSRLINFRNSDKNHNWDTREVYPTKELEKLLKDYSIEYGHGECIKAAICGESDKKFFAKLTSVLNTILQMRNSKTGTELDYLISPVADVNGNFFDSRQAPKNMPQDADANGAYHIGLKGLMLLGRIKNNQEGKKLNLVIKNEEYFEFVQNRNN

SEQ ID NO: 36 - protein, 1206 aa, Unknown
  Lachnospiraceae bacterium
MYYESLTKQYPVSKTIRNELIPIGKTLDNIRQNNILESDVKRKQNYEHVKGILDEYHKQLINEALDNCTLPSLKIAAEIYLKNQKEVSDREDFNKTQDLLRKEVVEKLKAHENFTKIGKKDILDLLEKLPSISEDDYNALESFRNFYTYFTSYNKVRENLYSDKEKSSTVAYRLINENFPKFLDNVKSYRFVKTAGILADGLGEEEQDSLFIVETFNKTLTQDGIDTYNSQVGKINSSINLYNQKNQKANGFRKIPKMKMLYKQILSDREESFIDEFQSDEVLIDNVESYGSVLIESLKSSKVSAFFDALRESKGKNVYVKNDLAKTAMSVIVFENWRTFDDLLNQEYDLANENKKKDDKYFEKRQKELKKNKSYSLEHLCNLSEDSCNLIENYIHQISDDIENIIINNETFLRIVINEHDRSRKLAKNRKAVKAIKDFLDSIKVLERELKLINSSGQELEKDLIVYSAHEELLVELKQVDSLYNMTRNYLTKKPFSTEKVKLNFNRSTLLNGWDRNKETDNLGVLLLKDGKYYLGIMNTSANKAFVNPPVAKTEKVFKKVDYKLLPVPNQMLPKVFFAKSNIDFYNPSSEIYSNYKKGTHKKGNMFSLEDCHNLIDFFKESISKHEDWSKFGFKFDTQASYNDISEFYREVEKQGYKLTYTDIDETYINDLIERNELYLFQIYNKDFSMYSKGKLNLHTLYFMMLFDQRNIDDVVYKLNGEAEVFYRPASISEDELIIHKAGEEIKNKNPNRARTKETSTFSYDIVKDKRYSKDKFTLHIPITMNFGVDEVKRFNDAVNSAIRIDENVNVIGIDRGERNLLYVVVIDSKGNILEQISLNSIINKEYDIETDYHALLDEREGGRDKARKDWNTVENIRDLKAGLYLQVVNVVAKLVLKYNAIICLEDLNFGFKRGRQKVEKQVYQKFEKMLIDKLNYLVIDKSREQTSPKELGGALNALQLTSKFKSFKELGKQSGVIYYVPAYLTSKIDPTTGFANLFYMKCENVEKSKRFFDGFDFIRFNALENVFEFGFDYRSFTQRACGINSKWTVCTNGERIIKYRNPDKNNMFDEKVVVVTDEMKNLFEQYKIPYEDGRNVKDMIISNEEAEFYRRLYRLLQQTLQMRNSTSDGTRDYIISPVKNKREAYFNSELSDGSVPKDADANGAYNIARKGLWVLEQIRQKSEGEKINLAMTNAEWLEYAQTHLL

SEQ ID NO: 37 - protein, 1233 aa, Unknown
  Lachnospiraceae bacterium
MDYGNGQFERRAPLTKTITLRLKPIGETRETIREQKLLEQDAAFRKLVETVTPIVDDCIRKIADNALCHFGTEYDFSCLGNAISKNDSKAIKKETEKVEKLLAKVLTENLPDGLRKVNDINSAAFIQDTLTSFVQDDADKRVLIQELKGKTVLMQRFLTTRITALTVWLPDRVFENFNIFIENAEKMRILLDSPLNEKIMKFDPDAEQYASLEFYGQCLSQKDIDSYNLIISGIYADDEVKNPGINEIVKEYNQQIRGDKDESPLPKLKKLHKQILMPVEKAFFVRVLSNDSDARSILEKILKDTEMLPSKIIEAMKEADAGDIAVYGSRLHELSHVIYGDHGKLSQIIYDKESKRISELMETLSPKERKESKKRLEGLEEHIRKSTYTFDELNRYAEKNVMAAYIAAVEESCAEIMRKEKDLRTLLSKEDVKIRGNRHNTLIVKNYFNAWTVFRNLIRILRRKSEAEIDSDFYDVLDDSVEVLSLTYKGENLCRSYITKKIGSDLKPEIATYGSALRPNSRWWSPGEKFNVKFHTIVRRDGRLYYFILPKGAKPVELEDMDGDIECLQMRKIPNPTIFLPKLVFKDPEAFFRDNPEADEFVFLSGMKAPVTITRETYEAYRYKLYTVGKLRDGEVSEEEYKRALLQVLTAYKEFLENRMIYADLNFGFKDLEEYKDSSEFIKQVETHNTFMCWAKVSSSQLDDLVKSGNGLLFEIWSERLESYYKYGNEKVLRGYEGVLLSILKDENLVSMRTLLNSRPMLVYRPKESSKPMVVHRDGSRVVDRFDKDGKYIPPEVHDELYRFFNNLLIKEKLGEKARKILDNKKVKVKVLESERVKWSKFYDEQFAVTFSVKKNADCLDTTKDLNAEVMEQYSESNRLILIRNTTDILYYLVLDKNGKVLKQRSLNIINDGARDVDWKERFRQVTKDRNEGYNEWDYSRTSNDLKEVYLNYALKEIAEAVIEYNAILIIEKMSNAFKDKYSFLDDVTFKGFETKKLAKLSDLHFRGIKDGEPCSFTNPLQLCQNDSNKILQDGVIFMVPNSMTRSLDPDTGFIFAINDHNIRTKKAKLNFLSKFDQLKVSSEGCLIMKYSGDSLPTHNTDNRVWNCCCNHPITNYDRETKKVEFIEEPVEELSRVLEENGIETDTELNKLNERENVPGKVVDAIYSLVLNYLRGTVSGVAGQRAVYYSPVTGKKYDISFIQAMNLNRKCDYYRIGSKERGEWTDFVAQLIN

SEQ ID NO: 38 - protein, 1227 aa, Unknown
  Lachnospiraceae bacterium
MSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIANINKCPKNIFKINTEVRVLLKHDDNPYVIGIDRGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIASNKEWLEYAQTSVKH

SEQ ID NO: 39 - protein, 1264 aa, Unknown
  Lachnospiraceae bacterium
MEDYSGFVNIYSIQKTLRFELKPVGKTLEHIEKKGFLKKDKIRAEDYKAVKKIIDKYHRAYIEEVFDSVLHQKKKKDKTRFSTQFIKEIKEFSELYYKTEKNIPDKERLEALSEKLRKMLVGAFKGEFSEEVAEKYNKNLFSKELIRNEIEKFCETDEERKQVSNFKSFTTYFTGFHSNRQNIYSDEKKSTAIGYRIIHQNLPKFLDNLKIIESIQRRFKDFPWSDLKKNLKKIDKNIKLTEYFSIDGFVNVLNQKGIDAYNTILGGKSEESGEKIQGLNEYINLYRQKNNIDRKNPLNVKILFKQILGDRETKSFIPEAFPDDQSVLNSITEFAKYLKLDKKKKSIIAELKKFLSSFNRYELDGIYLANDNSLASISTFLFDDWSFIKKSVSFKYDESVGDPKKKIKSPLKYEKEKEKWLKQKYYTISFLNDAIESYSKSQDEKRVKIRLEAYFAEFKSKDDAKKQFDLLERIEEAYAIVEPLLGAEYPRDRNLKADKKEVGKIKDFLDSIKSLQFFLKPLLSAEIFDEKDLGFYNQLEGYYEEIDISGHLYNKVRNYLTGKIYSKEKFKLNFENSTLLKGWDENREVANLCVIFREDQKYYLGVMDKENNTILSDIPKVKPNELFYEKMVYKLIPTPHMQLPRIIFSSDNLSIYNPSKSILKIREAKSFKEGKNFKLKDCHKFIDFYKESISKNEDWSRFDFKFSKTSSYENISEFYREVERQGYNLDFKKVSKFYIDSLVEDGKLYLFQIYNKDFSIFSKGKPNLHTIYFRSLFSKENLKDVCLKLNGEAEMFFRKKSINYDEKKKREGHHPELFEKLKYPILKDKRYSEDKFQFHLPISLNFKSKERLNFNLKVNEFLKRNKDINIIGIDRGERNLLYLVMINQKGEILKQTLLDSMQSGKGRPEINYKEKLQEKEIERDKARKSWGTVENIKELKEGYLSIVIHQISKLMVENNAIVVLEDLNIGFKRGRQKVERQVYQKFEKMLIDKLNFLVFKENKPTEPGGVLKAYQLTDEFQSFEKLSKQTGFLFYVPSWNTSKIDPRTGFIDFLHPAYENIEKAKQWINKFDSIRFNSKMDWFEFTADTRKFSENLMLGKNRVWVICTTNVERYFTSKTANSSIQYNSIQITEKLKELFVDIPFSNGQDLKPEILRKNDAVFFKSLLFYIKTTLSLRQNNGKKGEEEKDFILSPVVDSKGRFFNSLEASDDEPKDADANGAYHIALKGLMNLLVLNETKEENLSRPKWKIKNKDWLEFVWERNR

SEQ ID NO: 40 - protein, 1373 aa, Moraxella bovoculi
MLFQDFTHLYPLSKTVRFELFIDRTLEHIHAKNFLSQDETMADMHQKVKVILDDYHRDFIADMMGEVKLTKLAEFYDVYLKFRKNPKDDELQKAQLKDLQAVLRKEIVKPIGNGGKYKAGYDRLFGAKLFKDGKELGDLAKFVIAQEGESSPKLAHLAHFEKFSTYFTGFHDNRKNMYSDEDKHTAIAYRLIHENLPRFIDNLQILTTIKQKHSALYDQIINELTASGLDVSLASHLDGYHKLLTQEGITAYNTLLGGISGEAGSPKIQGINELINSHHNQHCHKSERIAKLRPLHKQILSDGMSVSFLPSKFADDSEMCQAVNEFYRHYADVFAKVQSLFDGFDDHQKDGIYVEHKNLNELSKQAFGDFALLGRVLDGYYVDVVNPEFNERFAKAKTDNAKAKLTKEKDKFIKGVHSLASLEQAIEHYTARHDDESVQAGKLGQYFKHGLAGVDNPIQKIHNNHSTIKGFLERERPAGERALPKIKSGKNPEMTQLRQLKELLDNALNVAHFAKLLTTKTTLDNQDGNFYGEFGVLYDELAKIPTLYNKVRDYLSQKPFSTEKYKLNFGNPTLLNGWDLNKEKDNFGVILQKDGCYYLALLDKAHKKVFDNAPNTGKSIYQKMIYKYLEVRKQFPKVFFSKEAIAINYHPSKELVEIKDKGRQRSDDERLKLYRFILECLKIHPKYDKKFEGAIGDIQLFKKDKKGREVPISEKDLFKDINGIFSSKPKLEMEDFFIGEFKRYNPSQDLVDQYNIYKKIDSNDNRKKENFYNNHPKFKKDLVRYYYESMCKHEEWEESFEFSKKLQDIGCYVDVNELFTEIETRRLNYKISFCNINADYIDELVEQGQLYLFQIYNKDFSPKAHGKPNLHTLYFKALFSEDNLADPIYKLNGEAQIFYRKASLDMNETTIHRAGEVLENKNPDNPKKRQFVYDIIKDKRYTQKDFMLHVPITMNFGVQGMTIKEFNKKVNQSIQQYDEVNVIGIDRGERHLLYLTVINSKGEILEQCSLNDITTASANGTQMTTPYHKILDKREIERLNARVGWGEIETIKELKSGYLSHVVHQISQLMLKYNAIVVLEDLNFGFKRGRFKVEKQIYQNFENALIKKLNHLVLKDKADDEIGSYKNALQLTNNFTDLKSIGKQTGFLFYVPAWNTSKIDPETGFVDLLKPRYENIQASQAFFGKFDKICYNADKDYFEFHIDYAKFTDKAKNSRQIWTICSHGDKRYVYDKTANQNKGAAKGINVNDILKSLFARHHINEKQPNLVMDICQNNDKEFHKSLMYLLKTLLALRYSNASSDEDFILSPVANDEGVFFNSALADDTQPQNADANGAYHIALKGLWLLNELKNSDDLNKVKLAIDNQTWLNFAQNR

SEQ ID NO: 41 - protein, 1352 aa, Parcubacteria bacterium
MENIFDQFIGKYSLSKTLRFELKPVGKTEDFLKINKVFEKDQTIDDSYNQAKFYFDSLHQKFIDAALASDKTSELSFQNFADVLEKQNKIILDKKREMGALRKRDKNAVGIDRLQKEINDAEDIIQKEKEKIYKDVRTLFDNEAESWKTYYQEREVDGKKITESKADLKQKGADFLTAAGILKVLKYEFPEEKEKEFQAKNQPSLFVEEKENPGQKRYIFDSFDKFAGYLTKFQQTKKNLYAADGTSTAVATRIADNFIIFHQNTKVFRDKYKNNHTDLGFDEENIFEIERYKNCLLQREIEHIKNENSYNKIIGRINKKIKEYRDQKAKDTKLTKSDFPFFKNLDKQILGEVEKEKQLIEKTREKTEEDVLIERFKEFIENNEERFTAAKKLMNAFCNGEFESEYEGIYLKNKAINTISRRWFVSDRDFELKLPQQKSKNKSEKNEPKVKKFISIAEIKNAVEELDGDIFKAVFYDKKIIAQGGSKLEQFLVIWKYEFEYLFRDIERENGEKLLGYDSCLKIAKQLGIFPQEKEAREKATAVIKNYADAGLGIFQMMKYFSLDDKDRKNTPGQLSTNFYAEYDGYYKDFEFIKYYNEFRNFITKKPFDEDKIKLNFENGALLKGWDENKEYDFMGVILKKEGRLYLGIMHKNHRKLFQSMGNAKGDNANRYQKMIYKQIADASKDVPRLLLTSKKAMEKFKPSQEILRIKKEKTFKRESKNFSLRDLHALIEYYRNCIPQYSNWSFYDFQFQDTGKYQNIKEFTDDVQKYGYKISFRDIDDEYINQALNEGKMYLFEVVNKDIYNTKNGSKNLHTLYFEHILSAENLNDPVFKLSGMAEIFQRQPSVNEREKITTQKNQCILDKGDRAYKYRRYTEKKIMFHMSLVLNTGKGEIKQVQFNKIINQRISSSDNEMRVNVIGIDRGEKNLLYYSVVKQNGEIIEQASLNEINGVNYRDKLIEREKERLKNRQSWKPVVKIKDLKKGYISHVIHKICQLIEKYSAIVVLEDLNMRFKQIRGGIERSVYQQFEKALIDKLGYLVFKDNRDLRAPGGVLNGYQLSAPFVSFEKMRKQTGILFYTQAEYTSKTDPITGFRKNVYISNSASLDKIKEAVKKFDAIGWDGKEQSYFFKYNPYNLADEKYKNSTVSKEWAIFASAPRIRRQKGEDGYWKYDRVKVNEEFEKLLKVWNFVNPKATDIKQEIIKKIKAGDLQGEKELDGRLRNFWHSFIYLFNLVLELRNSFSLQIKIKAGEVIAVDEGVDFIASPVKPFFTTPNPYIPSNLCWLAVENADANGAYNIARKGVMILKKIREHAKKDPEFKKLPNLFISNAEWDEAARDWGKYAGTTALNLDH

SEQ ID NO: 42 - protein, 1260 aa, Porphyromonas crevioricanis
MDSLKDFTNLYPVSKTLRFELKPVGKTLENIEKAGILKEDEHRAESYRRVKKIIDTYHKVFIDSSLENMAKMGIENEIKAMLQSFCELYKKDHRTEGEDKALDKIRAVLRGLIVGAFTGVCGRRENTVQNEKYESLFKEKLIKEILPDFVLSTEAESLPFSVEEATRSLKEFDSFTSYFAGFYENRKNIYSTKPQSTAIAYRLIHENLPKFIDNILVFQKIKEPIAKELEHIRADFSAGGYIKKDERLEDIFSLNYYIHVLSQAGIEKYNALIGKIVTEGDGEMKGLNEHINLYNQQRGREDRLPLFRPLYKQILSDREQLSYLPESFEKDEELLRALKEFYDHIAEDILGRTQQLMTSISEYDLSRIYVRNDSQLTDISKKMLGDWNAIYMARERAYDHEQAPKRITAKYERDRIKALKGEESISLANLNSCIAFLDNVRDCRVDTYLSTLGQKEGPHGLSNLVENVFASYHEAEQLLSFPYPEENNLIQDKDNVVLIKNLLDNISDLQRFLKPLWGMGDEPDKDERFYGEYNYIRGALDQVIPLYNKVRNYLTRKPYSTRKVKLNFGNSQLLSGWDRNKEKDNSCVILRKGQNFYLAIMNNRHKRSFENKMLPEYKEGEPYFEKMDYKFLPDPNKMLPKVFLSKKGIEIYKPSPKLLEQYGHGTHKKGDTFSMDDLHELIDFFKHSIEAHEDWKQFGFKFSDTATYENVSSFYREVEDQGYKLSFRKVSESYVYSLIDQGKLYLFQIYNKDFSPCSKGTPNLHTLYWRMLFDERNLADVIYKLDGKAEIFFREKSLKNDHPTHPAGKPIKKKSRQKKGEESLFEYDLVKDRRYTMDKFQFHVPITMNFKCSAGSKVNDMVNAHIREAKDMHVIGIDRGERNLLYICVIDSRGTILDQISLNTINDIDYHDLLESRDKDRQQEHRNWQTIEGIKELKQGYLSQAVHRIAELMVAYKAVVALEDLNMGFKRGRQKVESSVYQQFEKQLIDKLNYLVDKKKRPEDIGGLLRAYQFTAPFKSFKEMGKQNGFLFYIPAWNTSNIDPTTGFVNLFHVQYENVDKAKSFFQKFDSISYNPKKDWFEFAFDYKNFTKKAEGSRSMWILCTHGSRIKNFRNSQKNGQWDSEEFALTEAFKSLFVRYEIDYTADLKTAIVDEKQKDFFVDLLKLFKLTVQMRNSWKEKDLDYLISPVAGADGRFFDTREGNKSLPKDADANGAYNIALKGLWALRQIRQTSEGGKLKLAISNKEWLQFVQERSYEKD

SEQ ID NO: 43 - protein, 1324 aa, Prevotella disiens
MENYQEFTNLFQLNKTLRFELKPIGKTCELLEEGKIFASGSFLEKDKVRADNVSYVKKEIDKKHKIFIEETLSSFSISNDLLKQYFDCYNELKAFKKDCKSDEEEVKKTALRNKCTSIQRAMREAISQAFLKSPQKKLLAIKNLIENVFKADENVQHFSEFTSYFSGFETNRENFYSDEEKSTSIAYRLVHDNLPIFIKNIYIFEKLKEQFDAKTLSEIFENYKLYVAGSSLDEVFSLEYFNNTLTQKGIDNYNAVIGKIVKEDKQEIQGLNEHINLYNQKHKDRRLPFFISLKKQILSDREALSWLPDMFKNDSEVIDALKGFYIEDGFENNVLTPLATLLSSLDKYNLNGIFIRNNEALSSLSQNVYRNFSIDEAIDAQNAELQTFNNYELIANALRAKIKKETKQGRKSFEKYEEYIDKKVKAIDSLSIQEINELVENYVSEFNSNSGNMPRKVEDYFSLMRKGDFGSNDLIENIKTKLSAAEKLLGTKYQETAKDIFKKDENSKLIKELLDATKQFQHFIKPLLGTGEEADRDLVFYGDFLPLYEKFEELTLLYNKVRNRLTQKPYSKDKIRLCFNKPKLMTGWVDSKTEKSDNGTQYGGYLFRKKNEIGEYDYFLGISSKAQLFRKNEAVIGDYERLDYYQPKANTIYGSAYEGENSYKEDKKRLNKVIIAYIEQIKQTNIKKSIIESISKYPNISDDDKVTPSSLLEKIKKVSIDSYNGILSFKSFQSVNKEVIDNLLKTISPLKNKAEFLDLINKDYQIFTEVQAVIDEICKQKTFIYFPISNVELEKEMGDKDKPLCLFQISNKDLSFAKTFSANLRKKRGAENLHTMLFKALMEGNQDNLDLGSGAIFYRAKSLDGNKPTHPANEAIKCRNVANKDKVSLFTYDIYKNRRYMENKFLFHLSIVQNYKAANDSAQLNSSATEYIRKADDLHIIGIDRGERNLLYYSVIDMKGNIVEQDSLNIIRNNDLETDYHDLLDKREKERKANRQNWEAVEGIKDLKKGYLSQAVHQIAQLMLKYNAIIALEDLGQMFVTRGQKIEKAVYQQFEKSLVDKLSYLVDKKRPYNELGGILKAYQLASSITKNNSDKQNGFLFYVPAWNTSKIDPVTGFTDLLRPKAMTIKEAQDFFGAFDNISYNDKGYFEFETNYDKFKIRMKSAQTRWTICTFGNRIKRKKDKNYWNYEEVELTEEFKKLFKDSNIDYENCNLKEEIQNKDNRKFFDDLIKLLQLTLQMRNSDDKGNDYIISPVANAEGQFFDSRNGDKKLPLDADANGAYNIARKGLWNIRQIKQTKNKDDLNLSISSTEWLDFVREKPYLK

SEQ ID NO: 44 - protein, 1484 aa, Peregrinibacteria bacterium
  misc_feature (1073)..(1073): Xaa can be any naturally occurring amino acid
MSNFFKNFTNLYELSKTLRFELKPVGDTLTNMKDHLEYDEKLQTFLKDQNIDDAYQALKPQFDEIHEEFITDSLESKKAKEIDFSEYLDLFQEKKELNDSEKKLRNKIGETFNKAGEKWKKEKYPQYEWKKGSKIANGADILSCQDMLQFIKYKNPEDEKIKNYIDDTLKGFFTYFGGFNQNRANYYETKKEASTAVATRIVHENLPKFCDNVIQFKHIIKRKKDGTVEKTERKTEYLNAYQYLKNNNKITQIKDAETEKMIESTPIAEKIFDVYYFSSCLSQKQIEEYNRIIGHYNLLINLYNQAKRSEGKHLSANEKKYKDLPKFKTLYKQIGCGKKKDLFYTIKCDTEEEANKSRNEGKESHSVEEIINKAQEAINKYFKSNNDCENINTVPDFINYILTKENYEGVYWSKAAMNTISDKYFANYHDLQDRLKEAKVFQKADKKSEDDIKIPEAIELSGLFGVLDSLADWQTTLFKSSILSNEKLKIITDSQTPSEALLKMIFNDIEKNMESFLKETNDIITLKKYKGNKEGTEKIKQWFDYTLAINRMLKYFLVKENKIKGNSLDTNISEALKTLIYSDDAEWFKWYDALRNYLTQKPQDEAKENKLKLNFDNPSLAGGWDVNKECSNFCVILKDKNEKKYLAMIKKGENTLFQKEWTEGRGKNLTKKSNPLFEINNCEILSKMEYDFWADVSKMIPKCSTQLKAVVNHFKQSDNEFIFPIGYKVTSGEKFREECKISKQDFELNNKVFNKNELSVTAMRYDLSSTQEKQYIKAFQKEYWELLFKQEKRDTKLTNNEIFNEWINFCNKKYSELLSWERKYKDALTNWINFCKYFLSKYPKTTLFNYSFKESENYNSLDEFYRDVDICSYKLNINTTINKSILDRLVEEGKLYLFEIKNQDSNDGKSIGHKNNLHTIYWNAIFENFDNRPKLNGEAEIFYRKAISKDKLGIVKGKKTKNGTWIIKNYRFSKEKFILHVPITLNFCSNNEYVNDIVNTKFYNFSNLHFLGIDRGEKHLAYYSLVNKNGEIVDQGTLNLPFTDKDGNQRSIKKEKYFYNKQEDKWEAKEVDXWNYNDLLDAMASNRDMARKNWQRIGTIKEAKNGYVSLVIRKIADLAVNNERPAFIVLEDLNTGFKRSRQKIDKSVYQKFELALAKKLNFLVDKNAKRDEIGSPTKALQLTPPVNNYGDIENKKQAGIMLYTRANYTSQTDPATGWRKTIYLKAGPEETTYKKDGKIKNKSVKDQIIETFTDIGFDGKDYYFEYDKGEFVDEKTGEIKPKKWRLYSGENGKSLDRFRGEREKDKYEWKIDKIDIVKILDDLFVNFDKNISLLKQLKEGVELTRNNEHGTGESLRFAINLIQQIRNTGNNERDNDFILSPVRDENGKHFDSREYWDKETKGEKISMPSSGDANGAFNIARKGIIMNAHILANSDSKDLSLFVSDEEWDLHLNNKTEWKKQLNIFSSRKAMAKRKKKRPAATKK

SEQ ID NO: 45 - protein, 1245 aa, Porphyromonas macacae
MKTQHFFEDFTSLYSLSKTIRFELKPIGKTLENIKKNGLIRRDEQRLDDYEKLKKVIDEYHEDFIANILSSFSFSEEILQSYIQNLSISEARAKIEKTMRDTLAKAFSEDERYKSIFKKELVKKDIPVWCPAYKSLCKKFDNFTTSLVPFHENRKNLYTSNEITASIPYRIVHVNLPKFIQNIEALCELQKKMGADLYLEMMENLRNVWPSFVKTPDDLCNLKTYNHLMVQSSISEYNRFVGGYSTEDGTKHQGINEWINIYRQRNKEMRLPGLVFLHKQILAKVDSSSFISDTLENDDQVFCVLRQFRKLFWNTVSSKEDDAASLKDLFCGLSGYDPEAIYVSDAHLATISKNIFDRWNYISDAIRRKTEVLMPRKKESVERYAEKISKQIKKRQSYSLAELDDLLAHYSEESLPAGFSLLSYFTSLGGQKYLVSDGEVILYEEGSNIWDEVLIAFRDLQVILDKDFTEKKLGKDEEAVSVIKKALDSALRLRKFFDLLSGTGAEIRRDSSFYALYTDRMDKLKGLLKMYDKVRNYLTKKPYSIEKFKLHFDNPSLLSGWDKNKELNNLSVIFRQNGYYYLGIMTPKGKNLFKTLPKLGAEEMFYEKMEYKQIAEPMLMLPKVFFPKKTKPAFAPDQSVVDIYNKKTFKTGQKGFNKKDLYRLIDFYKEALTVHEWKLFNFSFSPTEQYRNIGEFFDEVREQAYKVSMVNVPASYIDEAVENGKLYLFQIYNKDFSPYSKGIPNLHTLYWKALFSEQNQSRVYKLCGGGELFYRKASLHMQDTTVHPKGISIHKKNLNKKGETSLFNYDLVKDKRFTEDKFFFHVPISINYKNKKITNVNQMVRDYIAQNDDLQHGIDRGERNLLYISRIDTRGNLLEQFSLNVIESDKGDLRTDYQKILGDREQERLRRRQEWKSIESIKDLKDGYMSQVVHKICNMVVEHKAIVVLENLNLSFMKGRKKVEKSVYEKFERMLVDKLNYLVVDKKNLSNEPGGLYAAYQLTNPLFSFEELHRYPQSGILFFVDPWNTSLTDPSTGFVNLLGRINYTNVGDARKFFDRFNAIRYDGKGNILFDLDLSRFDVRVETQRKLWTLTTFGSRIAKSKKSGKWMVERIENLSLCFLELFEQFNIGYRVEKDLKKAILSQDRKEFYVRLIYLFNLMMQIRNSDGEEDYILSPALNEKNLQFDSRLIEAKDLPVDADANGAYNVARKGLMVVQRIKRGDHESIHRIGRAQWLRYVQEGIVE

SEQ ID NO: 46 - protein, 1250 aa, Smithella sp.
MQTLFENFTNQYPVSKTLRFELIPQGKTKDFIEQKGLLKKDEDRAEKYKKVKNIIDEYHKDFIEKSLNGLKLDGLEKYKTLYLKQEKDDKDKKAFDKEKENLRKQIANAFRNNEKFKTLFAKELIKNDLMSFACEEDKKNVKEFEAFTTYFTGFHQNRANMYVADEKRTAIASRLIHENLPKFIDNIKIFEKMKKEAPELLSPFNQTLKDMKDVIKGTTLEEIFSLDYFNKTLTQSGIDIYNSVIGGRTPEEGKTKIKGLNEYINTDFNQKQTDKKKRQPKFKQLYKQILSDRQSLSFIAEAFKNDTEILEAIEKFYVNELLHFSNEGKSTNVLDAIKNAVSNLESFNLTKMYFRSGASLTDVSRKVFGEWSIINRALDNYYATTYPIKPREKSEKYEERKEKWLKQDFNVSLIQTAIDEYDNETVKGKNSGKVIADYFAKFCDDKETDLIQKVNEGYIAVKDLLNTPCPENEKLGSNKDQVKQIKAFMDSIMDIMHFVRPLSLKDTDKEKDETFYSLFTPLYDHLTQTIALYNKVRNYLTQKPYSTEKIKLNFENSTLLGGWDLNKETDNTAIILRKDNLYYLGIMDKRHNRIFRNVPKADKKDFCYEKMVYKLLPGANKMLPKVFFSQSRIQEFTPSAKLLENYANETHKKGDNFNLNHCHKLIDFFKDSINKHEDWKNFDFRFSATSTYADLSGFYHEVEHQGYKISFQSVADSFIDDLVNEGKLYLFQIYNKDFSPFSKGKPNLHTLYWKMLFDENNLKDVVYKLNGEAEVFYRKKSIAEKNTTIHKANESIINKNPDNPKATSTFNYDIVKDKRYTIDKFQFHIPITMNFKAEGIFNMNQRVNQFLKANPDINIIGIDRGERHLLYYALINQKGKILKQDTLNVIANEKQKVDYHNLLDKKEGDRATARQEWGVIETIKELKEGYLSQVIHKLTDLMIENNAIIVMEDLNFGFKRGRQKVEKQVYQKFEKMLIDKLNYLVDKNKKANELGGLLNAFQLANKFESFQKMGKQNGFIFYVPAWNTSKTDPATGFIDFLKPRYENLNQAKDFFEKFDSIRLNSKADYFEFAFDFKNFTEKADGGRTKWTVCTTNEDRYQWNRALNNNRGSQEKYDITAELKSLFDGKVDYKSGKDLKQQIASQESADFFKALMKNLSITLSLRHNNGEKGDNEQDYILSPVADSKGRFFDSRKADDDMPKNADANGAYHIALKGLWCLEQISKTDDLKKVKLAISNKEWLEFVQTLKG

SEQ ID NO: 47 - protein, 166 aa, Escherichia coli
SEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTD

SEQ ID NO: 48 - protein, 166 aa, Artificial Sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTD

SEQ ID NO: 49 - protein, 1646 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHHDGNPDPPPPEPPRKEVDDPRPQSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 50 - protein, 1653 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHERDKSKSSSKDQQQQDEQQYPPPPPQKDSSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 51 - protein, 1655 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHNSWLPPEVDEEKKDEENSSKEEKERKSSSSSRSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 52 - protein, 1655 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHNSWLPPEVDEEKKDEENSSKEEKERKSSSSSRSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSKRTADGSEF

SEQ ID NO: 53 - protein, 1653 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGQKHGSSDQKEGPPPVPPQPPIPSQPDKDRSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 54 - protein, 1653 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHFPPPPTDPNDQPQPPSDEQPGSQKDAEKDSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 55 - protein, 1652 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHDKESKDSPPSDSLKPQKDSPSRIESNNSGSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 56 - protein, 1652 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHDKESKDSPPSDSLKPQKDSPSRIESNNSGSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSKRTADGSEF

SEQ ID NO: 57 - protein, 1648 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHEQAKSSSQQTEETEIHQGKPPEQKSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 58 - protein, 1648 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHEQAKSSSQQTEETEIHQGKPPEQKSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSKRTADGSEF

SEQ ID NO: 59 - protein, 1649 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHIDDPPIPQPPEPRQKPEPPKYEPKNGSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 60 - protein, 1651 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHYHGPPEPPPPDNREDDKTQYQQKPPDFPSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 61 - protein, 1649 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHIPPNQEPPPQIPPIPPPQSPSQQQPSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 62 - protein, 1649 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHIPPNQEPPPQIPPIPPPQSPSQQQPSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSKRTADGSEF

SEQ ID NO: 63 - protein, 1651 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHTHPEQLFQEVIPPDGPDQVPDNSNTQPTSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 64 - protein, 1652 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHQPQPGDNTHFQQFQTQDDTPDTTTIQLQQSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 65 - protein, 1653 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHDHPIPEPDDQTIPNSSGTGTHPQQDEPDEQSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 66 - protein, 1654 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHQNTDPTHENPPQPPDLNPQSNQQDHSDPNQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSKRTADGSEF

SEQ ID NO: 67 - protein, 1654 aa, Artificial Sequence
  Synthetic polypeptide
MKRTADGSEFESPKKKRKVSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHQNTDPTHENPPQPPDLNPQSNQQDHSDPNQDSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDSGGSSGGSSGSETPGTSESATPESSGGSSGGSSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSKRTADGSEF

SEQ ID NO: 68 - protein, 1645 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDQKHPVQQEQKDENPQEQYRDKNESSSTGGSSDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 69 - protein, 1644 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDGQEEYKPPTEEQQPPEPSSSSGGDQPLPQGDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 70 - protein, 1648 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDPPSYVPKDPNRPDPSSDQRDPSPPTRELNPGNSDLSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 71 - protein, 1649 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDEGGQQPPSEQKKHPDNTKAEDQSISLLPSEDGRGDESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 72 - protein, 1646 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDPPQEPDGSDNTQAPTERDDRPQEPQSSGHSSTESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 73 - protein, 1649 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDDQPQSDGSVPPQDTSKDQSQDYSDDQPQEPTDQSKGSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 74 - protein, 1649 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDDGDKSDNLNPGDEEPSNGPPQPPPDDSKQLDNTPGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 75 - protein, 1647 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDNPPGPSDEPVIPVSKTEPPKKVEYKPDSKSNNDESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 76 - protein, 1644 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDYEDPSQPEPDHSSLSSEPPQKTSDQPSSSDSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 77 - protein, 1646 aa, Artificial Sequence
  Synthetic polypeptide
MAGSKKRRIKQDSEVEFSHEYWMRHALTLAKRAWDEREVPVGAVLVHNNRVIGEGWNRPIGRHDPTAHAEIMALRQGGLVMQNYRLIDATLYVTLEPCVMCAGAMIHSRIGRVVFGARDAKTGAAGSLMDVLHHPGMNHRVEITEGILADECAALLSDFFRMRRQEIKAQKKAQSSTDSGGSSGGSSGSETPGTSESATPESSGGSSGGSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMPRQVFNAQKKAQSSTDNSSSEQKYDVPEPPPPDLSSSKNEQSSPPKETESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHGSKKRRIKQD

SEQ ID NO: 78 - protein, 166 aa, Artificial Sequence
  Synthetic polypeptide
SEVEFSHEYWMRHALTLAKRAWDEREVPVGAVLVLNNRVIGEGWNRSIGLHDPTAHAEIMALRQGGLVMQNYRLIDATLYVTFEPCVMCAGAMIHSRIGRVVFGVRNAKTGAAGSLMDVLHYPGMNHRVEITEGILADECAALLCYFFRMRRQVFNAQKKAQSSTD

SEQ ID NO: 79 - protein, 166 aa, Artificial Sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMRRQVFNAQKKAQSSTD

SEQ ID NO: 80 - protein, 166 aa, Artificial Sequence
  Synthetic polypeptide
SEVEFSHEYWMRHALTLAKRALDEREVPVGAVLVLNNRVIGEGWNRAIGLHDPTAHAEIMALRQGGLVMQNYRLIDATLYVTFEPCVMCAGAMIHSRIGRVVFGVRNAKTGAAGSLMDVLHYPGMNHRVEITEGILADECNALLCYFFRMPRQVFNAQKKAQSSTD

SEQ ID NO: 81 - protein, 167 aa, Artificial Sequence
  Synthetic polypeptide
MSEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTD

SEQ ID NO: 82 - protein, 167 aa, Artificial Sequence
  Synthetic polypeptide
MSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 83 - DNA, 23 bp, Artificial Sequence
  Synthetic oligonucleotide
aagaaatattacaacatataaaa

SEQ ID NO: 84 - DNA, 23 bp, Artificial Sequence
  Synthetic oligonucleotide
aaatccagaatgcacaaagtact

SEQ ID NO: 85 - DNA, 23 bp, Artificial Sequence
  Synthetic oligonucleotide
atataatgcataataaaaaactt

SEQ ID NO: 86 - DNA, 23 bp, Artificial Sequence
  Synthetic oligonucleotide
tatgagttacaacgaacacctca

SEQ ID NO: 87 - DNA, 23 bp, Artificial Sequence
  Synthetic oligonucleotide
cacgtctcatatgccccttggca

SEQ ID NO: 88 - DNA, 23 bp, Artificial Sequence
  Synthetic oligonucleotide
gaacatgaaaacttaaatagaac

SEQ ID NO: 89 - DNA, 23 bp, Artificial Sequence
  Synthetic oligonucleotide
atgttctaaaaatgtatcccagt

SEQ ID NO: 90 - protein, 1425 aa, Artificial Sequence
  Synthetic polypeptide
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHNSWLPPEVDEEKKDEENSSKEEKERKSSSSSRSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 91 - protein, 1423 aa, Artificial Sequence
  Synthetic polypeptide
SKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKHERDKSKSSSKDQQQQDEQQYPPPPPQKDSSSEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSIN

SEQ ID NO: 92 - protein, 1429 aa, Artificial Sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINEGGQQPPSEQKKHPDNTKAEDQSISLLPSEDGRGDESKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 93 - protein, 1424 aa, Artificial Sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINGQEEYKPPTEEQQPPEPSSSSGGDQPLPQGDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 94 - protein, 1425 aa, Artificial Sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINQKHPVQQEQKDENPQEQYRDKNESSSTGGSSDSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 95 - protein, 1425 aa, Artificial Sequence
  Synthetic polypeptide
SEVEFSHEYWMRHALTLAKRARDEREVPVGAVLVLNNRVIGEGWNRAIGLHDPTAHAEIMALRQGGLVMQNYRLYDATLYSTFEPCVMCAGAMIHSRIGRVVFGVRNAKTGAAGSLMDVLHHPGMNHRVEITEGILADECAALLCRFFRMPRRVFNAQKKAQSSTDSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 96 - protein, 1425 aa, Artificial Sequence
  Synthetic polypeptide
SEVEFSHEYWMRHALTLAKRARDEREVPVGAVLVLNNRVIGEGWNRAIGLHDPTAHAEIMALRQGGLVMQNYRLIDATLYVTFEPCVMCAGAMIHSRIGRVVFGVRNSKRGAAGSLMNVLNYPGMNHRVEITEGILADECAALLCDFYRMPRQVFNAQKKAQSSINSGGSSGGSSGSETPGTSESATPESSGGSSGGSSKLEKFTNCYSLSKTLRFKAIPVGKTQENIDNKRLLVEDEKRAEDYKGVKKLLDRYYLSFINDVLHSIKLKNLNNYISLFRKKTRTEKENKELENLEINLRKEIAKAFKGNEGYKSLFKKDIIETILPEFLDDKDEIALVNSFNGFTTAFTGFFDNRENMFSEEAKSTSIAFRCINENLTRYISNMDIFEKVDAIFDKHEVQEIKEKILNSDYDVEDFFEGEFFNFVLTQEGIDVYNAIIGGFVTESGEKIKGLNEYINLYNQKTKQKLPKFKPLYKQVLSDRESLSFYGEGYTSDEEVLEVFRNTLNKNSEIFSSIKKLEKLFKNFDEYSSAGIFVKNGPAISTISKDIFGEWNVIRDKWNAEYDDIHLKKKAVVTEKYEDDRRKSFKKIGSFSLEQLQEYADADLSVVEKLKEIIIQKVDEIYKVYGSSEKLFDADFVLEKSLKKNDAVVAIMKDLLDSVKSFENYIKAFFGEGKETNRDESFYGDFVLAYDILLKVDHIYDAIRNYVTQKPYSKDKFKLYFQNPQFMGGWDKDKETDYRATILRYGSKYYLAIMDKKYAKCLQKIDKDDVNGNYEKINYKLLPGPNKMLPKVFFSKKWMAYYNPSEDIQKIYKNGTFKKGDMFNLNDCHKLIDFFKDSISRYPKWSNAYDFNFSETEKYKDIAGFYREVEEQGYKVSFESASKKEVDKLVEEGKLYMFQIYNKDFSDKSHGTPNLHTMYFKLLFDENNHGQIRLSGGAELFMRRASLKKEELVVHPANSPIANKNPDNPKKTTTLSYDVYKDKRFSEDQYELHIPIAINKCPKNIFKINTEVRVLLKHDDNPYVIGIARGERNLLYIVVVDGKGNIVEQYSLNEIINNFNGIRIKTDYHSLLDKKEKERFEARQNWTSIENIKELKAGYISQVVHKICELVEKYDAVIALEDLNSGFKNSRVKVEKQVYQKFEKMLIDKLNYMVDKKSNPCATGGALKGYQITNKFESFKSMSTQNGFIFYIPAWLTSKIDPSTGFVNLLKTKYTSIADSKKFISSFDRIMYVPEEDLFEFALDYKNFSRTDADYIKKWKLYSYGNRIRIFRNPKKNNVFDWEEVCLTSAYKELFNKYGINYQQGDIRALLCEQSDKAFYSSFMALMSLMLQMRNSITGRTDVDFLISPVKNSDGIFYDSRNYEAQENAILPKNADANGAYNIARKVLWAIGQFKKAEDEKLDKVKIAISNKEWLEYAQTSVKH

SEQ ID NO: 97 - DNA, 19 bp, Artificial sequence
  Synthetic oligonucleotide
  misc_feature (1)..(19): n is a, c, g, or t
nnnnnnnnnnnnnnnnnnn

SEQ ID NO: 98 - DNA, 22 bp, Artificial sequence
  Synthetic oligonucleotide
  misc_feature (4)..(22): n is a, c, g, or t
aaannnnnnnnnnnnnnnnnnn

SEQ ID NO: 99 - DNA, 22 bp, Artificial sequence
  Synthetic oligonucleotide
  misc_feature (4)..(22): n is a, c, g, or t
tttnnnnnnnnnnnnnnnnnnn

That which is claimed is:

1. A polypeptide comprising any one of the amino acid sequences of SEQ ID NOS: 1-24.

2. The polypeptide of claim 1, further comprising a polypeptide of interest linked to any one of the amino acid sequences of SEQ ID NOS: 1-24.

3. The polypeptide of claim 2, wherein the polypeptide of interest comprises a protein domain having deaminase activity, nickase activity, recombinase activity, transposase activity, methylase activity, glycosylase activity, glycosylase inhibitor activity, demethylase activity, transcription activation activity, transcription repression activity, transcription release factor activity, histone modification activity, nuclease activity, single-strand RNA cleavage activity, double-strand RNA cleavage activity, restriction endonuclease activity, nucleic acid binding activity, methyltransferase activity, DNA repair activity, DNA damage activity, dismutase activity, alkylation activity, depurination activity, oxidation activity, pyrimidine dimer forming activity, integrase activity, transposase activity, polymerase activity, ligase activity, helicase activity, and/or photolyase activity.

4. A polypeptide comprising a Cas12a domain linked to any one of the amino acid sequences of SEQ ID NOS: 1-24.

5. A fusion protein comprising a Cas12a domain, a polypeptide of interest and any one of the amino acid sequences of SEQ ID NOs: 1-24.

6. The polypeptide of claim 5, wherein the Cas12a domain comprises a mutation in the nuclease active site.

7. The fusion protein of claim 5, wherein the Cas12a domain is linked at its C-terminus and/or its N-terminus to any one of the amino acid sequences of SEQ ID NOs: 1-24.

8. The fusion protein claim 5, wherein the polypeptide of interest comprises an adenine deaminase domain.

9. The fusion protein of claim 8, wherein the adenine deaminase domain is TadA (tRNA-specific adenosine deaminase) and/or TadA* (evolved tRNA-specific adenosine deaminase).

10. A cell comprising the fusion protein of claim 8.

11. The cell of claim 10, wherein the cell is from an animal, a plant, a fungus, an archaeon, or a bacterium.

12. A method of modifying a target nucleic acid, comprising:

contacting the target nucleic acid with:
the fusion protein of claim 8, thereby modifying a target nucleic acid.

13. A method of editing a target nucleic acid, comprising:

contacting the target nucleic acid with the fusion protein of claim 8 and a guide nucleic acid, wherein the adenine deaminase domain converts an adenosine (A) to a guanine (G) in the target nucleic acid, thereby editing the target nucleic acid to produce a mutation.

14. The fusion protein of claim 5, wherein the fusion protein comprises an amino acid sequence of any one of SEQ ID NOs:49-77 or SEQ ID NOS:90-96.

15. The fusion protein of claim 5, wherein the adenine deaminase domain comprises, a first adenine deaminase domain; and
a second adenine deaminase domain; and
the Cas12a domain comprises a mutation in the nuclease active site,
wherein the second adenine deaminase domain is different from the first adenine deaminase domain, the C-terminus of the first adenine deaminase domain is linked to the N-terminus of the second deaminase domain, and the N-terminus of the Cas12a domain is linked to the C-terminus of the second adenine deaminase domain via any one of the amino acid sequences of SEQ ID NOs:1-10, optionally wherein the first adenine deaminase domain is a wild type adenosine deaminase domain and/or the second adenine deaminase domain is a mutated/evolved adenosine deaminase domain.

16. A cell comprising the fusion protein of claim 15.

17. The fusion protein of claim 5, wherein the adenine deaminase domain comprises a first adenine deaminase domain; and
a second adenine deaminase domain,
wherein the second adenine deaminase domain is different from the first adenine deaminase domain, and the C-terminus of the first adenine deaminase domain is linked to the N-terminus of the second deaminase domain and the C-terminus of the Cas12a domain is linked to the N-terminus of the first adenine deaminase domain, and
wherein when the first deaminase domain is a wild type adenine deaminase domain, the Cas12a domain is linked to the N-terminus of the first adenine deaminase domain via any one of the amino acid sequences of SEQ ID NOs:11-24, and when the first deaminase domain is a mutated/evolved adenine deaminase domain, the Cas12a domain is linked to the N-terminus of the first adenine deaminase domain via any one of the amino acid sequences of SEQ ID NOs:11-15.

18. The fusion protein of claim 17, wherein the first adenine deaminase domain is a wild type tRNA-specific adenosine deaminase or a mutated/evolved tRNA-specific adenosine deaminase domain and/or the second adenine deaminase domain is a wild type tRNA-specific adenosine deaminase or a mutated/evolved tRNA-specific adenosine deaminase domain, optionally the wild type tRNA-specific adenosine deaminase is a wild type *E. coli* TadA and/or the mutated/evolved tRNA-specific adenosine deaminase domain evolved is *E. coli* TadA*.

19. The fusion protein of claim 17, wherein the Cas12a domain comprises a mutation in the nuclease active site.

20. A complex comprising the fusion protein of claim 5, and a guide nucleic acid.

21. An expression cassette or vector comprising a polynucleotide encoding a fusion protein comprising a Cas12a domain and a polypeptide of interest, wherein the Cas12a domain and the polypeptide of interest are linked to one another via any one of the amino acid sequences of SEQ ID NOS: 1-24.

22. A cell comprising the expression cassette or vector of claim 21.

23. The cell of claim 22, wherein the cell is from an animal, a plant, a fungus, an archaeon, or a bacterium.

* * * * *

UNITED STATES PATENT AND TRADEMARK OFFICE
CERTIFICATE OF CORRECTION

| | |
|---|---|
| PATENT NO. | : 11,718,838 B2 |
| APPLICATION NO. | : 17/381465 |
| DATED | : August 8, 2023 |
| INVENTOR(S) | : Guffy et al. |

It is certified that error appears in the above-identified patent and that said Letters Patent is hereby corrected as shown below:

In the Specification

Column 1, Line 60: Please correct "AfiG or TfiC" to read --A→G or T→C--

Column 5, Lines 64-65: Please correct "-10%, -5%, -1%, -0.5%, or even -0.1%" to read --±10%, ±5%, ±1%, ±0.5%, or even ±0.1%--

Column 6, Line 1: Please correct "-10%, -5%, -1%, -0.5%, or even -0.1%" to read --±10%, ±5%, ±1%, ±0.5%, or even ±0.1%--

Column 10, Line 42: Please correct "0.2 · SSC" to read --0.2x SSC--

Column 10, Line 47: Please correct "1 · SSC" to read --1x SSC--

Column 10, Line 49: Please correct "4-6 · SSC" to read --4-6x SSC--

Column 10, Line 57: Please correct "2 ·" to read --2x--

Column 20, Line 32: Please correct "AfiG" to read --A→G--

Column 20, Line 33: Please correct "TfiC" to read --T→C--

Column 23-24, Lines 27-31: Please remove the sequence and replace with the following:
```
5'-NNNNNNNNNNNNNNNNNNNN-3' RNA Spacer (SEQ ID NO:97)
        | | | | | |   | ||||||| | || || | |
3'AAANNNNNNNNNNNNNNNNNNNNN-5' Target strand (SEQ ID NO:98)
   | | | |
5'TTTNNNNNNNNNNNNNNNNNNNNN-3' Non-target strand (SEQ ID NO:99)
```

Signed and Sealed this
Nineteenth Day of September, 2023

*Katherine Kelly Vidal*

Katherine Kelly Vidal
*Director of the United States Patent and Trademark Office*

CERTIFICATE OF CORRECTION (continued)
U.S. Pat. No. 11,718,838 B2

Column 27, Line 25: Please correct "AfiG" to read --A→G--

Column 27, Line 27: Please correct "TfiC" to read --T→C--

Column 27, Line 33: Please correct "AfiG or TfiC" to read --A→G or T→C--

Column 27, Lines 34-35: Please correct "AfiG or TfiC" to read --A→G or T→C--

Column 27, Line 36: Please correct "AfiG or TfiC" to read --A→G or T→C--

Column 27, Line 38: Please correct "AfiG or TfiC" to read --A→G or T→C--